United States Patent 11,931,406 (FLAVIVIRUS VACCINE) - sequence listing, part 45

SEQ ID NO: 16758 - RNA, 9879 nt, Artificial Sequence
  derived and/or modified CDS sequence (opt4) from DENV-1__KJ438293__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagaucagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccggcuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagaguggugcuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggaucgccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccauccuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacuggaucagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16759 - RNA, 9879 nt, Artificial Sequence
  derived and/or modified CDS sequence (opt4) from DENV-1__KJ438296__SS-prME
agcgugaccaugcugcugaugcugaugcccaccgcccuggccuuccaccugaccaccagaggcggcgagccccacaugauggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaucggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguucccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagaagacugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcaacugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16760 - RNA, 9879 nt, Artificial Sequence
  derived and/or modified CDS sequence (opt4) from DENV-1__KC692495__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16761 - RNA, 9879 nt, Artificial Sequence
  derived and/or modified CDS sequence (opt4) from DENV-1__KC692496__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggagacagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugcuggccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16762 - RNA, 9879 nt, Artificial Sequence
  derived and/or modified CDS sequence (opt4) from DENV-1__KC692497__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaccggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacgugaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16763 - RNA, 9879 nt, Artificial Sequence
  derived and/or modified CDS sequence (opt4) from DENV-1__KC692498__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaccggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuucagcggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacgugaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16764 - RNA, 9879 nt, Artificial Sequence
  derived and/or modified CDS sequence (opt4) from DENV-1__KC692499__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgugaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggaguacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucgccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16765 - RNA, 9879 nt, Artificial Sequence
  derived and/or modified CDS sequence (opt4) from DENV-1__KC692500__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaagggcaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauucaagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16766 - RNA, 9879 nt, Artificial Sequence
  derived and/or modified CDS sequence (opt4) from DENV-1__KC692501__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagaggagaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16767 - RNA, 9879 nt, Artificial Sequence
  derived and/or modified CDS sequence (opt4) from DENV-1__KC692502__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugagaaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagauggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaugagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucagccaggugagaagacugaucggcaacgagaacuaccuggacuacaugaccagcaugaagagauucaagaacgagagcgaccccgagggcgcccugugguga

SEQ ID NO: 16768 - RNA, 9879 nt, Artificial Sequence
  derived and/or modified CDS sequence (opt4) from DENV-1__KC692503__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacagacugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaucugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaucggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagaggagaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16769 - RNA, 9879 nt, Artificial Sequence
  derived and/or modified CDS sequence (opt4) from DENV-1__KC692504__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggagacagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaugaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacguguucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16770 - RNA, 9879 nt, Artificial Sequence
  derived and/or modified CDS sequence (opt4) from DENV-1__KC692508__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggagcacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16771 - RNA, 9879 nt, Artificial Sequence
  derived and/or modified CDS sequence (opt4) from DENV-1__KC692509__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugagaaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagauggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucagccaggugagaagacugaucggcaacgagaacuaccuggacuacaugaccagcaugaagagauucaagaacgagagcgaccccgagggcgcccugugguga

SEQ ID NO: 16772 - RNA, 9879 nt, Artificial Sequence
  derived and/or modified CDS sequence (opt4) from DENV-1__KC692510__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggagacagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16773 - RNA, 9879 nt, Artificial Sequence
  derived and/or modified CDS sequence (opt4) from DENV-1__KC692511__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaacugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacaucaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccaacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16774 - RNA, 9879 nt, Artificial Sequence
  derived and/or modified CDS sequence (opt4) from DENV-1__KC692512__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagaggagaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacagcaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacagaagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16775 - RNA, 9879 nt, Artificial Sequence
  derived and/or modified CDS sequence (opt4) from DENV-1__KC692513__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccccccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacaucaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcagcgagaacuaccuggacuacaugaccagcaugaagagauucaagaacgagagcgaccccgagggcgcccugugguga

SEQ ID NO: 16776 - RNA, 9879 nt, Artificial Sequence
  derived and/or modified CDS sequence (opt4) from DENV-1__KC692514__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggagacagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16777 - RNA, 9879 nt, Artificial Sequence
  derived and/or modified CDS sequence (opt4) from DENV-1__KC692515__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcggcaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagaggagaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacagcaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacagaagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16778 - RNA, 9879 nt, Artificial Sequence
  derived and/or modified CDS sequence (opt4) from DENV-1__KC692516__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacaacuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagccuggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccugcgugaagaaggaccugaucagcuacggcggcggcuggagauuccagggccuguggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcagaggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaagcaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16779 - RNA, 9879 nt, Artificial Sequence
  derived and/or modified CDS sequence (opt4) from DENV-1__KC692517__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaucgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccccccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagagcgugaacaucgagaccgagccccccuucggcgagagcuacaucguggugggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaacccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccaagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcuggugagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16780 - RNA, 9879 nt, Artificial Sequence
  derived and/or modified CDS sequence (opt4) from DENV-1__KC762649__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcgccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugagcaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaucuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16781 - RNA, 9879 nt, Artificial Sequence
  derived and/or modified CDS sequence (opt4) from DENV-1__KC762625__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugagcaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagagcugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16782 - RNA, 9879 nt, Artificial Sequence
  derived and/or modified CDS sequence (opt4) from DENV-1__KC762635__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16783 - RNA, 9879 nt, Artificial Sequence
  derived and/or modified CDS sequence (opt4) from DENV-1__KC762650__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccaucgaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16784 - RNA, 9879 nt, Artificial Sequence
  derived and/or modified CDS sequence (opt4) from DENV-1__KC762623__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugagcaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagagcugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguuccugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16785 - RNA, 9879 nt, Artificial Sequence
  derived and/or modified CDS sequence (opt4) from DENV-1__KC762632__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagaugcagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaucaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggaccagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16786 - RNA, 9879 nt, Artificial Sequence
  derived and/or modified CDS sequence (opt4) from DENV-1__KC762637__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16787 - RNA, 9879 nt, Artificial Sequence
  derived and/or modified CDS sequence (opt4) from DENV-1__KC762620__SS-prME
agcgugaccaugcuguucaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaucgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcagccaggacgagagaggcgugauccagaacggcagacugaucaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaaacaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacaaccagagagccuggaacaucugggagguggaggacuacggcuucggcguguucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggagagagccagcuucaucgaggugaagaccugcaucuggcccagaagccacacccuguggagcaacggcgugcuggagagcgagaugaucauccccaagaccuacggcggccccgugagccagcacaacuacagacccggcuacuucacccagaccgccggccccuggcaccugggcaagcuggagcuggacuucgaccugugcgagggcaccaccguggugguggacgagaacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcggcaagaugcugaugaccggcacccuggccguguuccugcugcugaccaugggccagcugaccuggaacgaccugaucagacugugcaucauggugggcgccaacgccagcgacaugaugggcaugggcaccaccuaccuggcccugauggccaccuucagaaugagacccauguucgccgugggccugcuguucagaagacugaccagcagagaggugcugcugcugaccgugggccugagccuggccgccagcguggagcugcccaacagccuggaggagcugggcgacggccuggccaugggcaucaugaugcugaagcugcugaccgacuuccagagccaccagcugugggccacccugcugagccugaccuucgugaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccaugcugcugaucaccgagaacaagaucuggggcagaagaagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggacgaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccauccugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagaguggugcagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaacagcaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagaaggcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccgugcccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaaccuguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccaagagagugcuggacuggcuggagaagcacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcugaucggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagagcgaccccgagggcgcccugugguga

SEQ ID NO: 16788 - RNA, 9879 nt, Artificial Sequence
  derived and/or modified CDS sequence (opt4) from DENV-1__KC762631__SS-prME
agcgugaccaugcugcugaugcugaugcccaccgcccuggccuuccaccugaccaccagaggcggcgagccccacaugaccgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaaccuguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaaccugggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgagaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggagcuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16789 - RNA, 9879 nt, Artificial Sequence
  derived and/or modified CDS sequence (opt4) from DENV-1__KC762621__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16790 - RNA, 9879 nt, Artificial Sequence
  derived and/or modified CDS sequence (opt4) from DENV-1__KC762643__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugauggcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcgugcugaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaucagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaaggcccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16791 - RNA, 9879 nt, Artificial Sequence
  derived and/or modified CDS sequence (opt4) from DENV-1__KC762651__SS-prME
agcgugaccaugcuguucaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcagccaggacgagagaggcgugauccagaacggcagacugaucaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacaaccagagagccuggaacaucugggagguggaggacuacggcuucggcguguucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggagagagccagcuucaucgaggugaagaccugcaucuggcccagaagccacacccuguggagcaacggcgugcuggagagcgagaugaucauccccaagaccuacggcggccccgugagccagcacaacuacagacccggcuacuucacccagaccgccggccccuggcaccugggcaagcuggagcuggacuucaaccugugcgagggcaccaccguggugguggacgagaacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcggcaagaugcugaugaccggcacccuggccguguuccugcugcugaccaugggccagcugaccuggaacgaccugaucagacugugcaucauggugggcgccaacgccagcgacaugaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagagccaccagcugugggccacccugcugagccugaccuucgugaagaccgccuucagccugcacuacgccuggaagaccauggccaugauccugagcaucgugagccuguucccccugugccugagcaccaccagccagaagaccaccuggcugcccgugcugcugggcagccugggcugcaagccccugaccaugcugcugaucaccgagaacaagaucuggggcagaagaagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggacgaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccauccugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagaguggugcagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccccaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagaaggcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccgugcccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaaccuguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccaagagagugcuggacuggcuggagaagcacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcugaucggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagagcgaccccgagggcgcccugugguga

SEQ ID NO: 16792 - RNA, 9879 nt, Artificial Sequence
  derived and/or modified CDS sequence (opt4) from DENV-1__KC762653__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcuaccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacugaucaccgccaaccccaucgugaccgacaaggagaagcccgugaacaucgaggccgagccccccuucggcgagagcuaccugguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcaugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgaggugaacggcauccuggcccagggcaagaagaugaucagaccccagcccauggagcacaaguacagcuggaagagcuggggcaaggccaaggugaucggcgccgacgugcagaacaccaccuucaucaucgacggccccaacacccccgagugccccgacaaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgagcugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaccaugggccagcugaccuggaacgaccugaucagacugugcaucauggugggcgccaacgccagcgacaagaugggcaugggcaccaccuaccuggcccugauggccaccuucagaaugagacccaugcuggccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagagccaccagcugugggccgcccugcugagccugaccuucgugaagaccacccugagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagaaggccgugcuggacgacggcaucuacagaauccugcagagaggccugcugggcaagagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcauggaggccuucccccagagcaacgccgccauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaaggugcugaaccccuacaugcccagcgugaucgagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucacccccagcgagcuggagacccccaaccuggccgagagagugcuggacuggcuggagaagcacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16793 - RNA, 9879 nt, Artificial Sequence
  derived and/or modified CDS sequence (opt4) from DENV-1__KC762640__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacugaucaccgccaaccccaucgugaccgacaaggagaagcccgugaacaucgaggccgagccccccuucggcgagagcuaccugguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgaggugaacggcauccuggcccagggcaagaagaugaucagaccccagcccauggagcacaaguacagcuggaagagcuggggcaaggccaaggugaucggcgccgacgugcagaacaccaccuucaucaucgacggccccaacacccccgagugccccgacaaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgagcugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaccaugggccagcugaccuggaacgaccugaucagacugugcaucauggugggcgccaacgccagcgacaagaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagagccaccagcugugggccgcccugcugagccugaccuucgugaagaccacccugagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagaaggccgugcuggacgacggcaucuacagaauccugcagagaggccugcugggcaagagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcauggaggccuucccccagagcaacgccgccauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugagaaugguggagcccuggcugagaggcaaccaguucugcaucaaggugcugaaccccuacaugcccagcgugaucgagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggagaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucacccccagcgagcuggagacccccaaccuggccgagagagugcuggacuggcuggagaagcacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16794 - RNA, 9879 nt, Artificial Sequence
  derived and/or modified CDS sequence (opt4) from DENV-1__KC762645__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcgugcagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16795 - RNA, 9879 nt, Artificial Sequence
  derived and/or modified CDS sequence (opt4) from DENV-1__KC762628__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacugaucaccgccaaccccaucgugaccgacaaggagaagcccgugaacaucgaggccgagccccccuucggcgagagcuaccugguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgaggugaacggcauccuggcccagggcaagaagaugaucagaccccagcccauggagcacaaguacagcuggaagagcuggggcaaggccaaggugaucggcgccgacgugcagaacaccaccuucaucaucgacggccccaacacccccgagugccccgacaaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgagcugugcgagggcaccaccguggugguggacgagcacugcggcagcagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaugagcaucaugaucgaggaggugaugagaagcagauggagcagaaagaugcugaugaccggcacccuggccguguuccugcugcugaccaugggccagcugaccuggaacgaccugaucagacugugcaucauggugggcgccaacgccagcgacaagaugggcaugggcaccacccaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagagccaccagcugugggccgcccugcugagccugaccuucgugaagaccacccugagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcaagagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcaucgaggccuucccccagagcaacgccgccauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugagaaugguggagcccuggcugagaggcaaccaguucugcaucaaggugcugaaccccuacaugcccagcgugaucgagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucacccccagcgagcuggagacccccaaccuggccgagagagugcuggacuggcuggagaagcacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16796 - RNA, 9879 nt, Artificial Sequence
  derived and/or modified CDS sequence (opt4) from DENV-1__KC762624__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16797 - RNA, 9879 nt, Artificial Sequence
  derived and/or modified CDS sequence (opt4) from DENV-1__KC762644__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucgagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16798 - RNA, 9879 nt, Artificial Sequence
  derived and/or modified CDS sequence (opt4) from DENV-1__KC762630__SS-prME
agcgugaccgugcuguucaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaucaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugauccagaacggcagacugaucaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacaaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccgugagccagcacaacuacagacccggcuacuucacccagaccgccggccccuggcaccugggcaagcuggagcuggacuucgaccugugcgagggcaccaccguggugguggacgagaacugcggcaacagaggccccagccugagaaccaccaccgugaccggcaagaccauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaccaugggccagcugaccuggaacgaccugaucagacugugcaucauggugggcgccaacgccagcgacaugaugggcaugggcaccaccuaccuggcccugauggccaccuucagaaugagacccauguucgccgugggccugcuguucagaagacugaccagcagagagauccugcugcugaccgugggccugagccugguggccagcguggagcugcccaacagccuggaggagcugggcgacggccuggccaugggcaucaugaugcugaagcugcugaccgacuuccagccccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaagaagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggacgaggccgagcacagcggcgccagccacaacauccugguggaggugcaggacgacggcaccaugaagaucaaggacgaggagagagacgacacccugaccauccugcugaaggccacccugcuggugaucagcggcguguaccccaugagcgugcccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgagaucggcgccaucgcccuggacuucaagcccggcaccagcggcagccccaucgugaacagagagggcaagaucgugggccuguacggcaacggcguggugaccaccagcggcaccuacgugagcgccaucgcccaggccaaggugagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagaguggugcagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccccaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugaaggcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugaucuacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccggcaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagaguguucgacuggcuggagaagcacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16799 - RNA, 9879 nt, Artificial Sequence
  derived and/or modified CDS sequence (opt4) from DENV-1__KC762641__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccgugaccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16800 - RNA, 9879 nt, Artificial Sequence
  derived and/or modified CDS sequence (opt4) from DENV-1__KC762648__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16801 - RNA, 9879 nt, Artificial Sequence
  derived and/or modified CDS sequence (opt4) from DENV-1__KC762622__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugauggcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaucagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaaggcccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16802 - RNA, 9879 nt, Artificial Sequence
  derived and/or modified CDS sequence (opt4) from DENV-1__KC762629__SS-prME
agcgugaccaugcugcugaugcugaugcccaccgcccuggccuuccaccugaccaccagaggcggcgagccccacaugguggugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaagacccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagaggcaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16803 - RNA, 9879 nt, Artificial Sequence
  derived and/or modified CDS sequence (opt4) from DENV-1__KC762627__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaugaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagaccagcaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16804 - RNA, 9879 nt, Artificial Sequence
  derived and/or modified CDS sequence (opt4) from DENV-1__KC762647__SS-prME
agcgugaccaugcugcugaugcugacccccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcagagccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagaaggcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaaggugcugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagcccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16805 - RNA, 9879 nt, Artificial Sequence
  derived and/or modified CDS sequence (opt4) from DENV-1__KC762639__SS-prME
agcgugaccaugcugcugaugcugacccccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcagagccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagaaggcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaaggugcugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16806 - RNA, 9879 nt, Artificial Sequence
  derived and/or modified CDS sequence (opt4) from DENV-1__KC762642__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccacccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaucaccggcacccuggccguguucuuccugcugaucaugggccaggugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaaguacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccguguucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuguacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16807 - RNA, 9879 nt, Artificial Sequence
  derived and/or modified CDS sequence (opt4) from DENV-1__JQ915077__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggacgagcugggcgacggccuggccaugggcaucaugauccugaagcugcugaccgacuuccagagccaccagcugugggccauccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucguguggcacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaccagcagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaccgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16808 - RNA, 9879 nt, Artificial Sequence
  derived and/or modified CDS sequence (opt4) from DENV-1__JQ915079__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccaccggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagagacccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggacgagcugggcgacggccuggccaugggcaucaugauccugaagcugcugaccgacuuccagagccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucguguggcacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaugggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaccagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacaccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagccaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggaggaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16809 - RNA, 9879 nt, Artificial Sequence
  derived and/or modified CDS sequence (opt4) from DENV-1__JQ915080__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccaccggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagagacccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggacgagcugggcgacggccuggccaugggcaucaugauccugaagcugcugaccgacuuccagagccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucguguggcacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaugggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaccagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacaccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagccaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggaggaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16810 - RNA, 9879 nt, Artificial Sequence
  derived and/or modified CDS sequence (opt4) from DENV-1__KJ755855__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggagcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcgagcuguucggcaagggcagccugcugaccugcgccaaguucaagugcgugaccaagcuggagggcaagaucgugcaguacgagaaccugaaguacagcgugaucgugaccgugcacaucgccgcccagcaccaggugggcaacgagagcaccgagcacggcaccaccgccaucaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacuguuccugcuggugaccuucaagaccgcccacgccaagaagcaggaggugguggugcugggcagccaggagggcgccaugcacaccgcccugaccggcgccaccgcccugcagaccuucggcaccaccaccaucuucgccggccaccugaacaucagacugaagauggacaagcugacccugaagggcaugagcuacgugaugugcaccggcagcuucaagcuggagaaggagguggccgagacccagcacggcaccauccuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgaccugaaguucaccgugguggugggcgacguggccggcauccuggcccagggcaagaagaugaucagaccccagcccauggagcacaaguacagcuggaagaacuggggcaaggccaagaucaucggcgccgacgugcagaacagcaccuucaucaucgacggccccaacacccccgagugcagcgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagccccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggugagccugagccugggccugcugugcaucagcaucaugaucgaggaggugaugagaagcagauggagcagaaagaugcugaugaccggcacccuggccguguucuucagaaagaucagaggccagcugaccuggaacgaccugaucagacugugcaucauggugggcgccaacgccagcgacagaaugggcaccagaaccaccuaccuggcccugauggccaccuucaagaugagacccauguucagcgugggccugcuguucagaagacugaccagcagagaggugcugcugcugaccaucggccugagccugguggccagcguggagcugcccaacagccuggaggagcugggcgugcugcuggccaugggcaucaugauccugacccugcugaccgacuuccagagccaccagcugugggccacccugcugagcaugaccuucaucaagaccaccuucagccugcacuacaccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccaagguggagaaggccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcuggggcagagugaagaaggaccugaucagcuacggcggcggcuggggccugaagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccacgccaaggccagccaggagggcccccugcccgagaccgagguggaggccuucagaaagagaaaccugaccaucauggaccugcaccccggcagcggcaagaccagaagauaccugcccgccaucgugagagaggccaucaagagaaagaugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagccuggccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuuccccgccgacagagugaucgaccccagaagaugccugaaccccgugauccugaaggacggccccgagagagugauccuggccggccccaugcccgugaccguggccagcgccaaccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagagaagaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaaggccggcaacggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucagacugcuguucaugauccugaccguggccgccaacgagaugggccugcuggagaccaccaagaaggaccugggcaucggccacgccgccguggagaaccaccaccacgccgccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcuuccugagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugagcccccugugggagggcagccccggcaagagcuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagaccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugagcgaggugagaggcuacaccaagggcggccccggccacgaggagcccauccccauggccaccuacggcugggaccugcugaagagaugcagcggcaaggaguucuucuucaucccccccgagaagugcgacagcuuccugggcgacaucggcgagagcagccccaaccccaccaucgaggagggcagaaccgugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcuggugaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagagugagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16811 - RNA, 9879 nt, Artificial Sequence
  derived and/or modified CDS sequence (opt4) from DENV-1__KF289073__SS-prME
agcgugaccaugcuguucaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaagaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcgugcugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccacagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaugggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagaaagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaaggcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccaccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcugaugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16812 - RNA, 9879 nt, Artificial Sequence
  derived and/or modified CDS sequence (opt4) from DENV-1__JQ915072__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccaccggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggccacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggacgagcugggcgacggccuggccaugggcaucaugauccugaagcugcugaccgacuuccagagccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucguguggcacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaugggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaccagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacaccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcagcagaagaggcaccggcgcccagggcgagacccugggcgagaaguggaagagacagcugaaccagcugagcaagagcgaguucaacaucuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggaggaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaagcaggugagaagacugaucggcaacgagaacuaccuggacuacaugaccagcaugaagagauucaagaacgagagcgaccccgagggcgcccugugguga

SEQ ID NO: 16813 - RNA, 9879 nt, Artificial Sequence
  derived and/or modified CDS sequence (opt4) from DENV-1__JQ915071__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgccaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccaccggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagagacccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggacgagcugggcgacggccuggccaugggcaucaugauccugaagcugcugaccgacuuccagagccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucguguggcacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcagcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaccagcagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacaccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccagagagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggaggaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16814 - RNA, 9879 nt, Artificial Sequence
  derived and/or modified CDS sequence (opt4) from DENV-1__JQ915073__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcuuccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccaccggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggccacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggacgagcugggcgacggccuggccaugggcaucaugauccugaagcugcugaccgacuuccagagccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucguguggcacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcgccgaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaccagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacaccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggaggaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16815 - RNA, 9879 nt, Artificial Sequence
  derived and/or modified CDS sequence (opt4) from DENV-1__JQ915075__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgccaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccaccggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagagacccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggacgagcugggcgacggccuggccaugggcaucaugauccugaagcugcugaccgacuuccagagccaccagcugugggccacccugcugagccugaccuucgugaagaccacccugagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucguguggcacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaucuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcagcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaccagcagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacaccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccauggccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccagagagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggaggaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16816 - RNA, 9879 nt, Artificial Sequence
  derived and/or modified CDS sequence (opt4) from DENV-1__JQ915076__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccaccggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggccacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggacgagcugggcgacggccuggccaugggcaucaugauccugaagcugcugaccgacuuccagagccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucguguggcacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaccagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacaccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggaggaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16817 - RNA, 9879 nt, Artificial Sequence
  derived and/or modified CDS sequence (opt4) from DENV-1__KF289072__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgccgugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcagauucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16818 - RNA, 9879 nt, Artificial Sequence
  derived and/or modified CDS sequence (opt4) from DENV-1__JQ692085__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgccgugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcagauucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccgugggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccaacgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16819 - RNA, 9879 nt, Artificial Sequence
  derived and/or modified CDS sequence (opt4) from DENV-1__JQ917404__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccagagagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcagauucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16820 - RNA, 9879 nt, Artificial Sequence
  derived and/or modified CDS sequence (opt4) from DENV-1__GU370048__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccugaacuucaacgagauggugcugcugaccaugaaggagaagagcuggcuggugcacaagcagugguuccuggaccugccccugcccuggaccagcggcgccagcaccacccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccagaagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaucaccggcacccuggccguguucuuccugcugaucaugggccaggugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagccccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuguacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16821 - RNA, 9879 nt, Artificial Sequence
  derived and/or modified CDS sequence (opt4) from DENV-1__KM403627__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggagagcuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16822 - RNA, 9879 nt, Artificial Sequence
  derived and/or modified CDS sequence (opt4) from DENV-1__KM403584__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgaggugcagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccuacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcagauucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggcaugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16823 - RNA, 9879 nt, Artificial Sequence
  derived and/or modified CDS sequence (opt4) from DENV-1__KM403633__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugagagagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16824 - RNA, 9879 nt, Artificial Sequence
  derived and/or modified CDS sequence (opt4) from DENV-1__KM403592__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcguggcccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccuggugagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccaugcccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16825 - RNA, 9879 nt, Artificial Sequence
  derived and/or modified CDS sequence (opt4) from DENV-1__KM403593__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcguggcccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16826 - RNA, 9879 nt, Artificial Sequence
  derived and/or modified CDS sequence (opt4) from DENV-1__KM403603__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagacccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16827 - RNA, 9879 nt, Artificial Sequence
  derived and/or modified CDS sequence (opt4) from DENV-1__KM403585__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcagaaucgugcaguacgagaaccugaaguacagcgugaucgugaccgugcacaccggcgaccagcaccaggugggcaacgagaccaccgagcacggcaccaucgccaccaucaccccccaggcccccaccagcgaggugcagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccuacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcagauucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucguggagguggacagaagcgaggccaaggagggcaugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16828 - RNA, 9879 nt, Artificial Sequence
  derived and/or modified CDS sequence (opt4) from DENV-1__KM403595__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacagaagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaucgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccaucuucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaccgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16829 - RNA, 9879 nt, Artificial Sequence
  derived and/or modified CDS sequence (opt4) from DENV-1__KM403604__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcagggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16830 - RNA, 9879 nt, Artificial Sequence
  derived and/or modified CDS sequence (opt4) from DENV-1__KM403588__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagaugggcaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaucgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucagagacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccguggccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16831 - RNA, 9879 nt, Artificial Sequence
  derived and/or modified CDS sequence (opt4) from DENV-1__KM403605__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcauccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagacccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcgaggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16832 - RNA, 9879 nt, Artificial Sequence
  derived and/or modified CDS sequence (opt4) from DENV-1__KM403606__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccacccuggagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagacccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16833 - RNA, 9879 nt, Artificial Sequence
  derived and/or modified CDS sequence (opt4) from DENV-1__KM403591__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagaugggcaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccaagagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16834 - RNA, 9879 nt, Artificial Sequence
  derived and/or modified CDS sequence (opt4) from DENV-1__KM403607__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcauccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagacccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16835 - RNA, 9879 nt, Artificial Sequence
  derived and/or modified CDS sequence (opt4) from DENV-1__KM403581__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacagaagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagcugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccaucuucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16836 - RNA, 9879 nt, Artificial Sequence
  derived and/or modified CDS sequence (opt4) from DENV-1__KM403597__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacagaagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccaucuucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaucugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16837 - RNA, 9879 nt, Artificial Sequence
  derived and/or modified CDS sequence (opt4) from DENV-1__KM403610__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccauccacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcagcgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcaagaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16838 - RNA, 9879 nt, Artificial Sequence
  derived and/or modified CDS sequence (opt4) from DENV-1__KM403596__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacagaagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugagccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaucgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccaucuucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaccgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16839 - RNA, 9879 nt, Artificial Sequence
  derived and/or modified CDS sequence (opt4) from DENV-1__KM403616__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugguggugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccgccuucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16840 - RNA, 9879 nt, Artificial Sequence
  derived and/or modified CDS sequence (opt4) from DENV-1__KM403617__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugguggugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16841 - RNA, 9879 nt, Artificial Sequence
  derived and/or modified CDS sequence (opt4) from DENV-1__KM403635__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcgccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacuggugggcaacgagaacuaccuggacuacaugaccagcaugaagagauucaagaacgagagcgaccccgagggcgcccugugguga

SEQ ID NO: 16842 - RNA, 9879 nt, Artificial Sequence
  derived and/or modified CDS sequence (opt4) from DENV-1__KM403621__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggagagcuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16843 - RNA, 9879 nt, Artificial Sequence
  derived and/or modified CDS sequence (opt4) from DENV-1__KM403623__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggagagcuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16844 - RNA, 9879 nt, Artificial Sequence
  derived and/or modified CDS sequence (opt4) from DENV-1__KM403575__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16845 - RNA, 9879 nt, Artificial Sequence
  derived and/or modified CDS sequence (opt4) from DENV-1__KM403586__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgaggugcagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccuacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcagauucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggcaugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16846 - RNA, 9879 nt, Artificial Sequence
  derived and/or modified CDS sequence (opt4) from DENV-1__KM403602__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgccaucacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcagcgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcaagaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16847 - RNA, 9879 nt, Artificial Sequence
  derived and/or modified CDS sequence (opt4) from DENV-1__KM403582__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacagaagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcaccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccaucuucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaccgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16848 - RNA, 9879 nt, Artificial Sequence
  derived and/or modified CDS sequence (opt4) from DENV-1__KM403577__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16849 - RNA, 9879 nt, Artificial Sequence
  derived and/or modified CDS sequence (opt4) from DENV-1__KM403631__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccaucaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16850 - RNA, 9879 nt, Artificial Sequence
  derived and/or modified CDS sequence (opt4) from DENV-1__KM403632__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucagaugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16851 - RNA, 9879 nt, Artificial Sequence
  derived and/or modified CDS sequence (opt4) from DENV-1__KM403583__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacagaagaagcguggcccuggccccccacgugggccugggccuggagaccagaaccgagaccuggaugagcagcgagggcgccuggagacagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccaucuucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16852 - RNA, 9879 nt, Artificial Sequence
  derived and/or modified CDS sequence (opt4) from DENV-1__KM403579__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcugggcaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaaagcugaucggcaacgagaacuaccuggacuacaugaccagcaugaagagauucaagaacgagagcgaccccgagggcgcccugugguga

SEQ ID NO: 16853 - RNA, 9879 nt, Artificial Sequence
  derived and/or modified CDS sequence (opt4) from DENV-1__HM469968__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgcccugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16854 - RNA, 9879 nt, Artificial Sequence
  derived and/or modified CDS sequence (opt4) from DENV-1__KC172834__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccaggccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaaccugggccacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugauccugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggggccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16855 - RNA, 9879 nt, Artificial Sequence
  derived and/or modified CDS sequence (opt4) from DENV-1__KJ933413__SS-prME
agcgugaccaugcugcugaugcugcugcccaccgcccuggccuuccaccugaccaccagaggcggcgagccccacaugaucgugagcaagcaggagagaggcaagagccugcuguucaagaccagcaccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaacccugguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucaccagccaggacgagaagggcgugacccagaacggcagacugaucaccgccaaccccaucgugaccgacaaggagaagcccgugaacaucgaggccgagccccccuucggcgagagcuaccugguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgugaccagacuggagaacaucauguggaagcagaucagcaacgagcugaaccacauccugcuggagaacgacaugaaguucaccgugguggugggcgacgugaacggcauccuggcccagggcaagaagaugaucagaccccagcccauggagcacaaguacagcuggaagagcuggggcaaggccaaggugaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcugaccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucggccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagagccaccagcugugggccgcccugcugagccugaccuucgugaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacagaaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcaagagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcauggaggccuucccccagagcaacgccgccauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagaguggugcagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagagccaccaccacgccgccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaaggugcugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccaagaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16856 - RNA, 9879 nt, Artificial Sequence
  derived and/or modified CDS sequence (opt4) from DENV-1__KU666942__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcaccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauacagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcauggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccaucgccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccgugcccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccaucaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagugcgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgagaucauggagcccgagcacgcccagcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggaugaaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16857 - RNA, 9879 nt, Artificial Sequence
  derived and/or modified CDS sequence (opt4) from DENV-1__KU666939__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggugcugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugccugcccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccugaucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugcugcuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16858 - RNA, 9879 nt, Artificial Sequence
  derived and/or modified CDS sequence (opt4) from DENV-1__KU666940__SS-prME
agcgugaccaugcugcugaugcugacccccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauacagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccaucgccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccgugcccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccaucaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagugcgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgagaucauggagcccgagcacgcccagcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggaugaaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16859 - RNA, 9879 nt, Artificial Sequence
  derived and/or modified CDS sequence (opt4) from DENV-1__KU666941__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucggcgccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauacagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccaucgccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccgugcccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccaucaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagugcgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgagaucauggagcccgagcacgcccagcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggaugaaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16860 - RNA, 9879 nt, Artificial Sequence
  derived and/or modified CDS sequence (opt4) from DENV-1__KC172835__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcguggugaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugagacugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaccauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaucggccagcugaccuggaacgaccugaucagacugagcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagccccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgcccuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgacgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggugcacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagagcgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucagccaggugagaagacugaucggcaacgagaacuaccuggacuacaugaccagcaugaagagauucaagaacgagagcgaccccgagggcgcccugugguga

SEQ ID NO: 16861 - RNA, 9879 nt, Artificial Sequence
  derived and/or modified CDS sequence (opt4) from DENV-1__EU848545__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcaccaucaucgccauggaccugggcgagcugugcgaggacaccaugaccuacaagugccccagaaucaccaaggccgagcccgacgacguggacugcuggugcaacgccaccgacaccugggugaccuacggcaccugcagcagaaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaagcccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccccccaggagaccuggaacagagaggaccugcuggugaccuucaagaccgcccacgccaagaagcaggaggugguggugcugggcagccaggagggcgccaugcacaccgcccugaccggcgccaccgagauccagaccagcggcaccaccaagaucuucgccggccaccugaagugcagacugaagaugaacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagaugcuggaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcgccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccugacccagggcagaaagaugaucggcccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccccagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacagcacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggacaaggaggagaaccuggugaagagccuggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccgcccugcugagccugaccuucaucaagaccaccuucagccugcacuacgccuggaagaccguggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgagaucagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaucagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagaggcaagagcgccgccaucgacggcgaguacagacugagaggcgaggccagaaagaccuucguggagcugaugagaagaggcgaccugcccguguggcugagcuacaagguggccagcgagggcuuccaguacagcgacagaaaguggugcuucgacggcgagagaaacaaccaggugcuggaggagaacauggacguggagaucuggaccaaggagggcgagagaaagaagcugagacccagauggcuggacgccagaaccuacagcgacccccaggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggguggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaucgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccaucgacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccuggagggcgcccugugguga

SEQ ID NO: 16862 - RNA, 9879 nt, Artificial Sequence
  derived and/or modified CDS sequence (opt4) from DENV-1__KR024708__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggagagcuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16863 - RNA, 9879 nt, Artificial Sequence
  derived and/or modified CDS sequence (opt4) from DENV-1__KR024705__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacgccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16864 - RNA, 9879 nt, Artificial Sequence
  derived and/or modified CDS sequence (opt4) from DENV-1__KR024706__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccggcgccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugggcggcgaggccagaaagaccuucguggagcugaugaagagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcuggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16865 - RNA, 9879 nt, Artificial Sequence
  derived and/or modified CDS sequence (opt4) from DENV-1__KR024707__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcugacccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16866 - RNA, 9879 nt, Artificial Sequence
  derived and/or modified CDS sequence (opt4) from DENV-1__KC172829__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcaccuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcguggugaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugagacugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaucggccagcugaccuggaacgaccugaucagacugagcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccaccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuucagcggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgacgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggugcacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagagcgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucagccaggugagaagacugaucggcaacgagaacuaccuggacuacaugaccagcaugaagagauucaagaacgagagcgaccccgagggcgcccugugguga

SEQ ID NO: 16867 - RNA, 9879 nt, Artificial Sequence
  derived and/or modified CDS sequence (opt4) from DENV-1__EU359008__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccacccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgcccugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccaggugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgccauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16868 - RNA, 9879 nt, Artificial Sequence
  derived and/or modified CDS sequence (opt4) from DENV-1__AY835999__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagcugggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgagaacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcauccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccagaccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgcccugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccagcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16869 - RNA, 9879 nt, Artificial Sequence
  derived and/or modified CDS sequence (opt4) from DENV-1__KP686070__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugagcaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16870 - RNA, 9876 nt, Artificial Sequence
  derived and/or modified CDS sequence (opt4) from DENV-1__KF672760__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaugaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccugcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugg

SEQ ID NO: 16871 - RNA, 9876 nt, Artificial Sequence
  derived and/or modified CDS sequence (opt4) from DENV-1__KF672759__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccugcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccaagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugg

SEQ ID NO: 16872 - RNA, 9876 nt, Artificial Sequence
  derived and/or modified CDS sequence (opt4) from DENV-1__KF672761__SS-prME
agcgugaccaugcuguucaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcggccacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugg

SEQ ID NO: 16873 - RNA, 9876 nt, Artificial Sequence
  derived and/or modified CDS sequence (opt4) from DENV-1__KF672762__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaucgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccaggugcugggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcagaaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccaucgacugggugcccaccagcagaaccaccuggagcauccacgcccaccaccaguggaugaccaccgaggacaugcugagcguguggaacagaguguggaucgaggagaaccccuggauggaggacaaggcccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugg

SEQ ID NO: 16874 - RNA, 9879 nt, Artificial Sequence
  derived and/or modified CDS sequence (opt4) from DENV-1__JF459993__SS-prME
agcgugaccaugcuguucaugcugcugcccaccagccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugggccaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugauccagaacggcagacugaucaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaaccacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgcccuggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccagcaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgaggagaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagaggugguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16875 - RNA, 9876 nt, Artificial Sequence
  derived and/or modified CDS sequence (opt4) from DENV-1__KF672763__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccgacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugauggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugagaaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugg

SEQ ID NO: 16876 - RNA, 9876 nt, Artificial Sequence
  derived and/or modified CDS sequence (opt4) from DENV-1__KF672764__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccaacggcauccugacccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaaccgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugg

SEQ ID NO: 16877 - RNA, 9879 nt, Artificial Sequence
  derived and/or modified CDS sequence (opt4) from DENV-1__EU863650__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggccuguucaagcuggagaaggagguggccgagacccagcacggcaccgugcuggugcaggugaaguacgagggcaccgacgcccccugcaagauccccuucagcagccaggacgagaagggcgccacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagccacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggacgagcugggcgacggccuggccaugggcaucaugauccugaagcugcugaccgacuuccagagccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucguguggcacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaaggcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaccagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaccgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaagaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcagcaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagccccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagccccccaaccuggccggcagagugcccgacuggcuggagaagcacggcaccgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16878 - RNA, 9879 nt, Artificial Sequence
  derived and/or modified CDS sequence (opt4) from DENV-1__KU365900__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggccccggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcugcugagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaaaguggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16879 - RNA, 9879 nt, Artificial Sequence
  derived and/or modified CDS sequence (opt4) from DENV-1__FJ176779__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugguggccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagaacuggggcaaggccaagaucaucggcgccgacgugcagaacagcaccuucaucaucgacggccccaacacccccgagugcagcgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagcaugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagaugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgaguuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggugaccaaccuggacaucaucggccagagaaucgagaacaucaaguacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16880 - RNA, 9879 nt, Artificial Sequence
  derived and/or modified CDS sequence (opt4) from DENV-1__FJ176780__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaccagccuggaggagcugggcgacggccuggccaugggcaucaugauccugaagcugcugaccgacuuccagagccaccagcugugggccacccugcugagccugaccuucgugaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuaccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggugaccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucuaccaggugagaagacugaucggcaacgagaacuaccuggacuacaugaccagcaugaagagauucaagaacgagagcgaccccgagggcgcccugugguga

SEQ ID NO: 16881 - RNA, 9879 nt, Artificial Sequence
  derived and/or modified CDS sequence (opt4) from DENV-1__JN205310__SS-prME
agcgugaccgugcuguucaugcugcugcccaccgcccuggccuuccaccugaccacccugggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccccagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaucaucaccccccaggcccccaccagcgagauccagcugaccgacuacggcgcccugacccccgacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccagcagcagccaggacgagaagggcgugauccagaacggcagacugaucaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacaaccagagagccuggaacaucugggagguggaggacuacggcuucggcaucuucaccaccaacaucuggcugaagcugagagacagcuucacccaggugugcgaccacagacugaugagcgccgccaucaaggacagcaaggccgugcacgccgacaugggcuacuggaucgagagcgagaagaaggagaccuggaagcuggccagagccagcuucaucgaggugaagaccugcaucuggcccaagagccacacccuguggagcaacggcgugcuggagagcgagaugaucauccccaagaucuacggcggccccgugagccagcacaacuacagacccggcuacuucacccagaccgccggccccuggcaccugggcaagcuggagcuggacuucgaccugugcgagggcaccaccguggugguggacgagaacugcggcaacagaggccccagccugagaaccaccaccgugaccggcaagaccacccacgagagaugcugcagaagcugcacccugcccccccugagauucaagagagaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaccaugggccagagcaccuggaacgaccugaucagacugugcaccauggugggcgccaacgccagcgacaugaugggcaugggcaccaccuaccuggcccugauggccaccuucagaaugagacccauguucgccgugggccugcuguucagaagacugaccagcagagagauccugcugcugaccgugggccugagccugguggccagcguggagcugcccaacagccuggaggagcugggcgacggccuggccaugggcaucaugaugcugaagcugcugaccgacuuccagccccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaagaagcuggccccugaacgagggcaucauggccaucggcaucgugagcauccugcugagcagcccccugaagaacgacgugccccuggccggcccccugaucgccggcggcaugcugaucgccugcuacgugaucagcggcagcagcgccgaccugagccuggagaaggccgccgaggugagcugggaggacgaggccgagcacagcggcgccagccacaacauccugguggaggugcaggacgacggcaccaugaagaucaaggacgaggagagagacgacacccugaccauccugcugaaggccacccugcuggugaucagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagcaccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagaguggugcagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccccaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugaaggcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccacgccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaagaucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcagaagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccaccacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagaguguucgacuggcuggagaagcacggcaucgagagacugaagagaauggccaucagcggcgacgacugcguggugaagcccaucgacgacagauucgccaccgcccugaccgcccugaacgacaugggcaaggugagaaaggacaucccccagugggagccccccaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16882 - RNA, 9879 nt, Artificial Sequence
  derived and/or modified CDS sequence (opt4) from DENV-1__HQ332182__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcgccagccaggugcugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccgugggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16883 - RNA, 9879 nt, Artificial Sequence
  derived and/or modified CDS sequence (opt4) from DENV-1__HQ332181__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggugcagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcaccggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccgcccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16884 - RNA, 9879 nt, Artificial Sequence
  derived and/or modified CDS sequence (opt4) from DENV-1__HQ332180__SS-prME
agcgugaccaugcugcugaugcugcugcccaccgcccuggccuuccaccugaccaccagaggcggcgagccccacaugaucaucagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgccauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccacccaccuggcccugauggccaccuucaagaugagacccauguucgccgugggccugcuguucagaagacugaccagcagagaggugcugcugcugaccaucggccugagccugauggccagcauggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccaugauccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16885 - RNA, 9879 nt, Artificial Sequence
  derived and/or modified CDS sequence (opt4) from DENV-1__HQ332179__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugcugcuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccugcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16886 - RNA, 9879 nt, Artificial Sequence
  derived and/or modified CDS sequence (opt4) from DENV-1__KR919820__SS-prME
accgugguggcccugcugaugcugcugcccaugguguucagcuuccaccugaccaccagaggcggcgagccccacaugaucgugaacaagcaggagagaggcaagagccugcuguucaagaccagcggcggcaucaacaugugcacccugaucgccauggaccugggcgaccugugcgaggacaccaugaccuacaagugccccagaaucaccgaggccgagcccgacgacguggacugcuggugcaacgccaccgacaccugggugaccuacggcaucugcagccccaccggcgagcacagaagagagaagagaagcguggcccuggccccccacgugggccugggccuggagaccagagccgagaccuggaugagcagcgagggcgccuggaagcagauccagagaguggagaccugggcccugagacaccccggcuucaccgugaucgcccuguuccuggcccacaucaucggcaccagcaucacccagaagggcgugaucuucauccugcugaugcuggugacccccagcauggccaugagaugcgugggcgugggcaacagagacuucguggagggccugagcggcgccaccuggguggacguggugcuggagcacggcagcugcgugaccaccauggccaagaacaagcccacccuggacaucgagcugcugaagaccgaggugagcaaccccgccgugcugagaaagcugugcaucgaggccagaaucagcaacaccaccaccgacagcagaugccccacccagggcgaggccagccugagcgaggagcaggacaccaacuucgugugcagaagaacccugguggacagaggcuggggcaacggcugcggccuguucggcaagggcagccugaucaccugcgccaaguucgagugccugaccaagauggagggcaagaucgugcaguacgagaaccugaaguacagcgugaucgugaccgugcacaccggcgaccagcaccaggugggcaacgagaccaccggccacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccugggccagcggcgccagcagcccccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcugaagaaggagguggccgagacccagcacggcaccgugcuggugcagguggaguacgagggcaccgacgcccccugcaagauccccuucaccacccaggacgagaagggcgugauccagaacggcagacugaucaccgccaaccccaucgugaccgacaaggagaagcccgugaacaucgaggccgagccccccuucggcgagagcuacauggugaucggcgugggcgacaaggcccugaagcugagcugguucaagaagggcagcagccugggcaagauguucgaggccaccgccagaggcgccagaagaauggccauccugggcgacaccgccugggacuucggcagcgugggcggcguguucaccagcaugggcaagcuggugcaccagaucuucggcaccgccuacggcgugcuguucagcggcgugagcuggaccaugaagaucggcaucggccugcugcugaccuggcugggccugaacagcagaagcaccagccugagcaugaccugcaucgccgugggcaucaucacccuguaccugggcgugauggugcaggccgacaccggcugcguggugaacuggaagggcagagagcugaagugcggcagcggcaucuucgugaccaacgaggugcacaccuggaccgagcaguacaaguuccaggccgacagccccaagagacugagcgccgccaucggcaaggccugggaggacggcgugugcggcaucagaagcgccaccagacuggagaacaucauguggaagcagaucgccaacgagcugaacuacauccugcuggagaacgacaugaaguucaccgugguggugggcgacgugaagggcauccugacccagggcaagaagggcaucagaccccagcccauggagcacaaguacagcuggaagagcuggggcaaggccaagaucaucggcgccgacgugcagaacaccaccuucaucaucgacggccccgacacccccgagugccccgacagccagagagccuggaacaucugggagguggaggacuacggcuucggcaucuucaccaccaacaucuggcugaagcugagagacagcuacacccaggugugcgaccacagacugaugagcgccgccaucaaggacagcagagccgugcacgccgacaugggcuacuggaucgagagcgagaagaacgagaccuggaagcugagcagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcagugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcaagguggacaacuucagccugggccugcugugcaucagcaucaugguggaggaggugaugagaagcagauggagcggcaagaugcugaugaccggcaccauggccguguuccugcugcuggugaugggccagcugaccuggaacgaccugaucagagugugcaucauggugggcgcccacgcccuggacagcaugggcaugggcaccaccuaccuggcccugauggccaccuucaagaucagacccaugcuggccgugggccugcuguucagaaagcugaccagcagagagauccugcugcugaccaucggccugagccugaucacccccguggagcugcccaacagcaucgaggagcugggcgacggccuggccaugggcaucaugaugcugaagcugcugaccgacuuccagcccuaccagcugugggccacccugcugagccugaccuucgugaagaccacccugagccugcacuacgccuggaagaccgccgccauggugcugagcaucgugagccugcugccccugugccugagcaccaccagccagaagaccaccuggcugcccauccugcugggcagccugggcugcaagccccugaccauguuccugaucagcgagaacaagaucuggggcagaagaagcuggcccaucaacgagggcaucauggccgugggcaucgugagcauccugaugagcagccugcugaagaacgacgugccccuggccggcccccugaucgccggcggcaugcugguggccugcuacgugaucagcggcagcagcgccgaccugacccuggagaagaccgccgaggugagcugggaggaggaggccgagcacagcggcaccgcccacaacauccugguggaggugcaggacgacggcaccaugaagaucaaggacgaggagagagaggacacccugaccauccugcugaaggccgcccugcuggcccugagcggcguguaccccaugagcauccccgccacccuguucgugugguacuucuggcagaagaagaagcagagaagcggcgugcugugggacauccccagcccccccgagguggagaaggccgugcuggacgacggcaucuacagaauccugcagagaggcguguucggcagaagccaggugggcgugggcguguuccaggagggcguguuccacaccauguggcacgugaccagaggcgccgugcugaccuaccagggcaagagacuggagcccagcugggccagcgugaagaaggaccugaucagcuacggcggcggcuggagacugcagggcagcuggaacgugggcgaggaggugcaggugaucgccguggagcccggcaagaaccccaagaacgugcagaccgugcccggcaccuucaagacccacgagggcgaggugggcgccaucgcccuggacuucaagcccggcaccagcggcagccccaucgugaacagagacggcaagguggugggccuguacggcaacggcguggugaccaccagcggcaccuacgugagcgccaucgcccagagcaaggugagccaggagggcccccugcccgagaucgaggacgagguguucaagaagaagaaccugaccaucauggaccugcaccccggcagcggcaagaccagaagauaccugcccgccaucgugagagagagcaucaagagaagacugagaacccugauccuggcccccaccagagugguggccagcgagauggccgaggcccugaagggccugcccaucagauaccagaccaccgccgugagaaacgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcgccgaggccuucccccagagcaacagcgugaucuacgacgaggagaaggacauccccgagagaagcuggaacagcggcuacgacuggaucaccgacuuccagggcaagaccgugugguucgugcccagcaucaagaccggcaacgacaucgccaacugccugagaaagaacggcaagagagugauccagcugagcagaaagaccuucgacaccgaguaccagaagaccaagaacagcgacugggacuucguggugaccaccgacaucagcgagaugggcgccaacuucagagccgacagagugaucgaccccagaagaugccugaagcccgugauccugagagacggccccgagagagugauccuggccggccccaugcccgugaccguggccagcgccgcccagagaagaggcagaaucggcagaaaccagagcaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcauccaguacgccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccaccaccugacccagagagcccagaacgcccuggacaaccuggugaugcugcacaacagcgagcagggcggcagagccuacagacacgccauggaggagcugcccgacaccaucgagacccugaugcugcuggccaugaucgccacccugaccggcggcguggcccuguucuuccugagcggcaagggccugggcaagaccagcaucggccugcugugcgugauggccagcagcacccugcuguggauggccagcguggagccccacuggaucgccgccagcaucgugcuggaguucuuccugauggugcugcugauccccgagcccgacagacagagaaccccccaggacaaccagcuggccuacguggugaucggccugcuggugcugauccugaccguggccgccaacgagaugggccugcuggagaccaccaagaaggaccugggcaucggcagcgccgccgccgagauccagcaccacaccaccauccuggacguggaccugcaccccgccagcgccuggacccuguacgccguggccaccaccgugaucacccccaugcugagacacaccaucgagaacaccaccgccaacaugagccugaccgccaucgccaaccaggccgccauccugaugggccuggacaagggcuggcccaucagcaagauggacaucggcgugccccugcuggcccugggcugcuacagccaggugaaccccaugacccugaccgccgccgugcugaugcugguggcccacuacgccaucaucggccccggccugcaggccaaggccaccagagacgcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggccuucugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcaacagaagaggcaccggcgcccagggcgagacccugggcgagaaguggaagagacagcugaaccagcugagcaagcuggaguucaacaccuacaagagaagcggcaucauggagguggacagaaccgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaaggugcugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagaaggacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccaggugauggagaucaccgccggcuggcuguggaaguuccugagcagaaagaagaagcccagaaucugcaccagagaggaguucaccagaaaggugagaagcaacgccgccaucggcgccguguucguggacgagaaccaguggaacagcgccaaggaggccguggacgacgagagauucugggaccuggugaacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagacaacagccugagcggcguggagggcgagggccugcacaagcugggcuacauccugagagacaucgccagaauccccggcggcaacauguacgccgacgacaccgccggcugggacaccagaaucaccgaggaggaccugcagaacgaggccagagugaccgagcugauggagcccgaccacgcccagcuggccaccagcaucuucagacugaccuaccagaacaagguggugagagugcagagacccggcaagaacggcaccgugauggacgugaucagcagaagagaccagagaggcagcggccaggugggcaccuacggccugaacaccuucaccaacauggaggcccagcugaucagacagauggagagcgagggcguguucagccccagcgagcuggagacccccaaccuggccaacagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcagaggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugaccagcugggaggacgugcccuaccugggcaagagagaggaccaguggugcggcagccugaucggccugagcgccagagccaccugggccaucaacauccagguggccaucaaccaggugagaaagcugaucggcaacgagcacuaccaggacuacaugaccagcaugagaagauucaagaacgagagcgagcccgagggcgcccugugguga

SEQ ID NO: 16887 - RNA, 9879 nt, Artificial Sequence
  derived and/or modified CDS sequence (opt4) from DENV-1__DQ285561__SS-prME
agcgugaccaugcugcugaugcugcugcccaccgcccugaccuuccaccugaccaccagaggcggcgagccccacaugaucgugggcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaucuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcaugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagagcaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaccaugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugauccugaagcugcugaccgacuuccagagccaccagcugugggccacccugcugagccugaccuucgugaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccggcuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaugagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucguggagguggacagaagcgaggccaaggagggccugaagagaggcgagaccaucaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacaugggcgcccagcugaucagacagauggagagcgagggcaucuucagccccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16888 - RNA, 9879 nt, Artificial Sequence
  derived and/or modified CDS sequence (opt4) from DENV-1__DQ285562__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacaccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucguggugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugagaagcauggugagcgccggcagcggcgagguggacagcuucagccugggccugcugugcgugagcaucaugguggaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccaucgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucaccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacguguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacaucaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaagcaggugagaagacugaucggcaacgagaacuaccuggacuacaugaccagcaugaagagauucaagaacgagagcgaccccgagggcgcccugugguga

SEQ ID NO: 16889 - RNA, 9879 nt, Artificial Sequence
  derived and/or modified CDS sequence (opt4) from DENV-1__DQ285558__SS-prME
agcgugaccaugcugcugaugcugcugcccaccgcccugaccuuccaccugaccaccagaggcggcgagccccacaugaucgugggcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagagcaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaccaugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugauccugaagcugcugaccgacuuccagagccaccagcugugggccacccugcugagccugaccuucgugaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaugagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucguggagguggacagaagcgaggccaaggagggccugaagagaggcgagaccaucaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacaugggcgcccagcugaucagacagauggagagcgagggcaucuucagccccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16890 - RNA, 9879 nt, Artificial Sequence
  derived and/or modified CDS sequence (opt4) from DENV-1__DQ285559__SS-prME
agcgugaccaugcugcugaugcugcugcccaccgcccugaccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaucgacuacggcgcccugacccuggacugcagccccagaaccggccuggacuucaacgagauggugcugcugaccaugaagggcaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugacccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagaagcugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcaaguggagcagaaagaugcugaugaccggcacccuggccguguuccugcugcugaucaugggccagcugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagccccaccagcuguggaccacccugcugagccugaccuucaucaagaccacccugagccuggacuacgccuggaagaccauggccaugacccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccgccaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccaagagagugcuggacuggcuggagaaguacggcgccgagagacugaagagaauggccaucagcggcgacgacugcguggugaagcccaucgacgacagauucgccaaggcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacauggccagcaugaagagauucaagaacgagagcgaccccgagggcgcccugugguga

SEQ ID NO: 16891 - RNA, 9879 nt, Artificial Sequence
  derived and/or modified CDS sequence (opt4) from DENV-1__AF311956__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccauccuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16892 - RNA, 9879 nt, Artificial Sequence
  derived and/or modified CDS sequence (opt4) from DENV-1__AF311958__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcacccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgaguacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggaggagccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcgccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16893 - RNA, 9879 nt, Artificial Sequence
  derived and/or modified CDS sequence (opt4) from DENV-1__AF311957__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccaccgugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcagcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16894 - RNA, 9879 nt, Artificial Sequence
  derived and/or modified CDS sequence (opt4) from DENV-1__EU280167__SS-prME
agcgugaccaugcugcugacccugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccgugaccuacaagugccccagaaucaccgaggccgagcccgacgacguggacugcuggugcaacgccaccgacaccugggugaccuacggcaccugcagccagaccggcgagcacagaagagacaucagaagcguggcccuggccccccacgugggccugggccuggagaccagaaccgagaccuggaugagcagcgagggcgccuggaagcagauccagagaguggacaccugcgugcugagacaccccggcuucaccgugaucgcccuguuccuggcccacgccaucggcaccagcaucagccagaagggcaucaucuucauccugcugaugcuggugacccccagcaugaccaugagaugcgugggcaucggcagcagagacuucguggagggccugagcggcgccaccuggguggacguggugcuggagcacggcagcugcgugaccagcauggccaaggacaagcccacccuggacaucgagcugcugaagaccgaggugcccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgacaaguucaagugcgugaccaagcuggagggcaagaucauccaguacgagaacuucaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagcagagagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagaggccugaagugcggcagcggcaucuucgugaccaacgaggugcacaccuggaccggccaguacaaguuccaggccgacagccccaagggccugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagaacuggggcaaggccaagaucaucggcgccgacgugcagaacagcaccuucaucaucgacggccccaacacccccgagugcagcgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugggcaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuucagaagccaccagcugugggccacccugcugagcaugaccuucaucaagaccgccuucagccugcacuacgccuggaagaccauggccauggugcugagcaucgugagccuguucccccugugccuguacaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggugcuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagaugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucaccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugauggaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaccaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagccacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucaugguggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaccaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgagggcgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcgagagagaggaccaguggugcggcagccugaucggccugaccgccagagccaccugggccaccaacgugcagguggccaucaaccaggugagaagacugaucggcaacgagaacuacagcgacuacaugaccagcaugaagagauucaagaacaagagcgagcccgagggcgcccugugguga

SEQ ID NO: 16895 - RNA, 9876 nt, Artificial Sequence
  derived and/or modified CDS sequence (opt4) from DENV-2__AJ968413__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcuggccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacgugaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaccaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcacgccggcaagagaagccugagaccccagcccaccgagcugagauacagcuggaagaccuggggcaaggccaagauccugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccacccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcguggugcugcugagccagagcaccauccccgagaccauccuggagcugaccgacgcccuggcccugggcaugauggugcugaagaucgugagaaagauggagagauaccagcuggccgugaccaucaccgccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaaacggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacauccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucuggggccugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16896 - RNA, 9876 nt, Artificial Sequence
  derived and/or modified CDS sequence (opt4) from DENV-2__AB543624__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaucggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccccgagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacaaccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucgcccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagagacaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaacggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcaccccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcccccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaaccacacccacuucugcaucaaggugcugaaccccuacaugcccagcgugcuggagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagagacugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 16897 - RNA, 9876 nt, Artificial Sequence
  derived and/or modified CDS sequence (opt4) from DENV-2__AB189122__SS-prME
accgccggcgugaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggccccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgugggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagaacaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagguguacaagaagagcggcauccaggagguggacagaacccuggccaaggagggcaucgagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16898 - RNA, 9876 nt, Artificial Sequence
  derived and/or modified CDS sequence (opt4) from DENV-2__AB189123__SS-prME
accgccggcgugaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggccccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagaacaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcaucgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucgagagaggcgagaccgaccaccacgccgugagcagaggcagcgccaagcugagaugcuucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaagaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugcuggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16899 - RNA, 9876 nt, Artificial Sequence
  derived and/or modified CDS sequence (opt4) from DENV-2__AB189124__SS-prME
accgccggcgugaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggccccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagaacaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucgagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaagaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16900 - RNA, 9876 nt, Artificial Sequence
  derived and/or modified CDS sequence (opt4) from DENV-2__AB122020__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16901 - RNA, 9876 nt, Artificial Sequence
  derived and/or modified CDS sequence (opt4) from DENV-2__LC121816__SS-prME
accgugggcaugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccgugaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggcccacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggaggugaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagagagacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggccuacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcaccacaaccagacccugcugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgcccugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccguggugagcgugaccccccugcugcugaccagcagcagacagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccgacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucagacaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccaaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagagcauccagcaccugaccgccaccgaggagaucgccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16902 - RNA, 9876 nt, Artificial Sequence
  derived and/or modified CDS sequence (opt4) from DENV-2__LC111438__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagcccccccaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagccuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugaccaugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugauggccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccaaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagaucgugaccaacuacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccguggagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16903 - RNA, 9876 nt, Artificial Sequence
  derived and/or modified CDS sequence (opt4) from DENV-2__KF744400__SS-prME
accgccggcaugaucaucaugcugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaaggagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgacauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacgugaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaccaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcacgccggcaagagaagccugagaccccagcccaccgagcugagauacagcuggaagaccuggggcaaggccaagauccugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacgccuucugcgaccccaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagcuggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacaagggcgaggacggcugcugguacggcauggagaucagaccccugaaggagaaggaggagaaccuggugagcagccuggugaccgccggccacggccagaucgacaacuucagccugggcgugcugggcauggcccuguuccuggaggagaugcugagaaccagagugggcaugaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaagauggagagauaccagcuggccgugaccaucauggccauccugugcgugcccaacagcgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugagaugggaggaccaggccgagaucagcggcagcagccccauccugagcgugaucgugagcgaggacggcagcaugagcaucaagaacgaggaggaggagcagauccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaaacggcagcuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgccaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccugcaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgaggccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccuguacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcugaccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16904 - RNA, 9876 nt, Artificial Sequence
  derived and/or modified CDS sequence (opt4) from DENV-2__KF744401__SS-prME
accgccggcaugaucaucaugcugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaaggagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacgugaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugguggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaccaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcacgccggcaagagaagccugagaccccagcccaccgagcugagauacagcuggaagaccuggggcaaggccaagauccugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacgccuucugcgaccccaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagcuggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacaagggcgaggacggcugcugguacggcauggagaucagaccccugaaggagaaggaggagaaccuggugagcagccuggugaccgccggccacggccagaucgacaacuucagccugggcgugcugggcauggcccuguuccuggaggagaugcugagaaccagagugggcaugaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaagauggagagauaccagcuggccgugaccaucauggccauccugugcgugcccaacagcgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugagaugggaggaccaggccgagaucagcggcagcagccccauccugagcgugaucgugagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaaacggcagcuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgccaucgaccuggaccccauccccuacgaccccaaguucgagaagcagcugggccaggugaugcugcuggugcugugcgugacccaggugcuggugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgaggccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccuguacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcugaccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16905 - RNA, 9876 nt, Artificial Sequence
  derived and/or modified CDS sequence (opt4) from DENV-2__KF744402__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccaccaacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacgugaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccugauccuggugggcguggugacccuguaccugggcgugguggugcaggccgacagcggcugcguggugagcuggagaaacaaggagcugaagugcggcagcggcaucuucaucaccgacaacgugcacaccuggaccgagcaguacaaguuccagcccgagagccccagcaagcuggccagcgccauccagaaggcccaccaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcacgccggcaagagaagccugagaccccagcccaccgagcugagauacagcuggaagaccuggggcagagccaagauccugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacaccauccugcugguggccgugagcuucgugacccugaucaccggcaacaugagcuucagagaccugggcagagugauggugauggugggcgccaccaugaccgacaacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaucaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaucaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaaacggcagcuacgugagcgccaucgcccagaccggcaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggaccacgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16906 - RNA, 9876 nt, Artificial Sequence
  derived and/or modified CDS sequence (opt4) from DENV-2__KF744408__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccaccaacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccugggcuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacgugaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugguggugcaggccgacagcggcugcguggugagcuggagaaacaaggagcugaagugcggcagcggcaucuucaucaccgacaacgugcacaccuggaccgagcaguacaaguuccagcccgagagccccagcaagcuggccagcgccauccagaaggcccaccaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugagauacagcuggaagaccuggggcaaggccaagauccugagcaccgagagccacaaccagaccuuccugaucgacggccccgagaccgccgagugccccaacaccaacagagccuggaacagccuggagguggaggacuacggcuucggcguguucaccaccaacaucuggcugagacugagagagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcaagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugagaugggaggaccaggccgagaucagcggcagcagccccauccugagcaucaucaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaaacggcagcuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacaugaucacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16907 - RNA, 9876 nt, Artificial Sequence
  derived and/or modified CDS sequence (opt4) from DENV-2__JX669476__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagagcgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgaguuccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagguggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcagagccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacgacagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 16908 - RNA, 9876 nt, Artificial Sequence
  derived and/or modified CDS sequence (opt4) from DENV-2__JX475906__SS-prME
accgugggcaugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccgugaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggaggugaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgcccugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagcagacagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccaggccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagagcauccagcaccugaccgccaccgaggagaucgccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16909 - RNA, 9876 nt, Artificial Sequence
  derived and/or modified CDS sequence (opt4) from DENV-2__JX669477__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacaccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggcccacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucagaagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 16910 - RNA, 9876 nt, Artificial Sequence
  derived and/or modified CDS sequence (opt4) from DENV-2__JX669478__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaucgacuacaugcccagcaugaagagauucagaagagaggaggaggaggccggcgugcugugguga

SEQ ID NO: 16911 - RNA, 9876 nt, Artificial Sequence
  derived and/or modified CDS sequence (opt4) from DENV-2__JX669480__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcgaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgugaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacaccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16912 - RNA, 9876 nt, Artificial Sequence
  derived and/or modified CDS sequence (opt4) from DENV-2__JX669483__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcgaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucaaggugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgugaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacaccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16913 - RNA, 9876 nt, Artificial Sequence
  derived and/or modified CDS sequence (opt4) from DENV-2__JX669484__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacggcaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugauggugauggugggcguggccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucaugaccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaucaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16914 - RNA, 9876 nt, Artificial Sequence
  derived and/or modified CDS sequence (opt4) from DENV-2__JX669485__SS-prME
accgccggcgugaucaucaugcugauccccaccgccauggccuuccaccugaccaccagaaacggcgagccccacaugaucgugggcaagcaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacggcaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugaucgugauggugggcgugaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcuggacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16915 - RNA, 9876 nt, Artificial Sequence
  derived and/or modified CDS sequence (opt4) from DENV-2__JX669486__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcgaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgugaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccacccccgagaccauccuggagcugaccgacgcccuggcccugggcaugauggugcugaagaucgugagaaacauggagaaguaccagcuggccgugaccaucaugaccauccugugcgugcccaacgccgugauccugcugaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugguggaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccguguucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16916 - RNA, 9876 nt, Artificial Sequence
  derived and/or modified CDS sequence (opt4) from DENV-2__JX669487__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucaugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgugaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugagaaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccaucagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaagcacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccuggccgagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16917 - RNA, 9876 nt, Artificial Sequence
  derived and/or modified CDS sequence (opt4) from DENV-2__JX669488__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugagaaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccaucagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaagcacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccuggccgagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16918 - RNA, 9876 nt, Artificial Sequence
  derived and/or modified CDS sequence (opt4) from DENV-2__JX669479__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagagcgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcagagccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaaggcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 16919 - RNA, 9876 nt, Artificial Sequence
  derived and/or modified CDS sequence (opt4) from DENV-2__KF744403__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccaccaacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacgugaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugguggugcaggccgacagcggcugcguggugagcuggagaaacaaggagcugaagugcggcagcggcaucuucaucaccgacaacgugcacaccuggaccgagcaguacaaguuccagcccgagagccccagcaagcuggccagcgccauccagaaggcccaccaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcacgccggcaagagaagccugagaccccagcccaccgagcugagauacagcuggaagaccuggggcaaggccaagauccugagcaccgagagccacaaccagaccuuccugaucgacggccccgagaccgccgagugccccaacaccaacagagccuggaacagccuggagguggaggacuacggcuucggcguguucaccaccaacaucuggcugagacugagagagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcaagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaagauggagagauaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugagaugggaggaccaggccgagaucagcggcagcagccccauccugagcaucaucaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaaacggcagcuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagauccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacaugaucacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16920 - RNA, 9876 nt, Artificial Sequence
  derived and/or modified CDS sequence (opt4) from DENV-2__KF744406__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccaccaacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacgugaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugguggugcaggccgacagcggcugcguggugagcuggagaaacaaggagcugaagugcggcagcggcaucuucaucaccgacaacgugcacaccuggaccgagcaguacaaguuccagcccgagagccccagcaagcuggccagcgccauccagaaggcccaccaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcacgccggcaagagaagccugagaccccagcccaccgagcugagauacagcuggaagaccuggggcaaggccaagauccugagcaccgagagccacaaccagaccuuccugaucgacggccccgagaccgccgagugccccaacaccaacagagccuggaacagccuggagguggaggacuacggcuucggcguguucaccaccaacaucuggcugagacugagagagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcaagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaagauggagagauaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugagaugggaggaccaggccgagaucagcggcagcagccccauccugagcaucaucaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaaacggcagcuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagaucagccugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacaugaucacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16921 - RNA, 9876 nt, Artificial Sequence
  derived and/or modified CDS sequence (opt4) from DENV-2__KF744404__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccaccaacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacgugaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugguggugcaggccgacagcggcugcguggugagcuggagaaacaaggagcugaagugcggcagcggcaucuucaucaccgacaacgugcacaccuggaccgagcaguacaaguuccagcccgagagccccagcaagcuggccagcgccauccagaaggcccaccaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcacgccggcaagagaagccugagaccccagcccaccgagcugagauacagcuggaagaccuggggcaaggccaagauccugagcaccgagagccacaaccagaccuuccugaucgacggccccgagaccgccgagugccccaacaccaacagagccuggaacagccuggagguggaggacuacggcuucggcguguucaccaccaacaucuggcugagacugagagagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcaagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaagauggagagauaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugagaugggaggaccaggccgagaucagcggcagcagccccauccugagcaucaucaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaaacggcagcuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccugcagaucagccugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacaugaucacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16922 - RNA, 9876 nt, Artificial Sequence
  derived and/or modified CDS sequence (opt4) from DENV-2__KF744407__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccaccaacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacgugaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggccagcuggaagaacaaggagcugaagugcggcagcggcaucuucaucaccgacaacgugcacaccuggaccgagcaguacaaguuccagcccgagagccccagcaagcuggccagcgccauccagaaggcccaccaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcacgccggcaagagaagccugagaccccagcccaccgagcugagauacagcuggaagaccuggggcaaggccaagauccugagcaccgagagccacaaccagaccuuccugaucgacggccccgagaccgccgagugccccaacaccaacagagccuggaacagccuggagguggaggacuacggcuucggcguguucaccaccaacaucuggcugagacugagagagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugagaugggaggagcaggccgagaucagcggcagcagccccauccugagcaucaucaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaaacggcagcuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacaugaucacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgccaccgaggagaucgccgugcagaacuggcugaccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16923 - RNA, 9876 nt, Artificial Sequence
  derived and/or modified CDS sequence (opt4) from DENV-2__KF744399__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccaccaacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccugggcuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacgugaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaccaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcacgccggcaagagaagccugagaccccagcccaccgagcugagauacagcuggaaggccuggggcaaggccaagauccugagcaccgagcugcacaaccagaccuuccugaucgacggccccgagaccgccgagugccccaacaccaacagagccuggaacagccuggagguggaggacuacggcuucggcguguucaccaccaacaucuggcugaagcugagagagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcaagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaagauggagagauaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugagaugggaggagcaggccgagaucagcggcagcagccccauccugagcaucaucaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagacuggagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaaacggcagcuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgccaccgaggagaacgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagaacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16924 - RNA, 9876 nt, Artificial Sequence
  derived and/or modified CDS sequence (opt4) from DENV-2__JX286516__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaucgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaagggcuucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 16925 - RNA, 9876 nt, Artificial Sequence
  derived and/or modified CDS sequence (opt4) from DENV-2__JX286518__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 16926 - RNA, 9876 nt, Artificial Sequence
  derived and/or modified CDS sequence (opt4) from DENV-2__JX286519__SS-prME
accgccggcgugaucgugaugcugauccccaccgccauggccuuccaccugaccaccagaaacggcgagccccacaugaucgugggcagacaggagaagggcaagagccugcuguucaagaccgaggacggcaucaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucgugcccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaagcgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 16927 - RNA, 9876 nt, Artificial Sequence
  derived and/or modified CDS sequence (opt4) from DENV-2__KP188549__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagauggugauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcgagaagagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaccgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 16928 - RNA, 9876 nt, Artificial Sequence
  derived and/or modified CDS sequence (opt4) from DENV-2__KP188550__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcagagcccacacccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcaccaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccaaguggcuguggaaggagcugggcaaggagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagaacauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 16929 - RNA, 9876 nt, Artificial Sequence
  derived and/or modified CDS sequence (opt4) from DENV-2__KP188553__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagauggugauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcgagaagagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccccuacagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaccgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 16930 - RNA, 9876 nt, Artificial Sequence
  derived and/or modified CDS sequence (opt4) from DENV-2__KP188556__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagauggugauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcgagaagagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccaucccccacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaccgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 16931 - RNA, 9876 nt, Artificial Sequence
  derived and/or modified CDS sequence (opt4) from DENV-2__GU369819__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugagagccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacaucgagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagguguacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccccccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16932 - RNA, 9876 nt, Artificial Sequence
  derived and/or modified CDS sequence (opt4) from DENV-2__JX649147__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagagcgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagaaggcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaaggagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaagaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugaagaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16933 - RNA, 9876 nt, Artificial Sequence
  derived and/or modified CDS sequence (opt4) from DENV-2__KF704356__SS-prME
accgccggcaugaucaucaugcugauccccaccgugauggccuuccaccugaccaccagaaacggcgagccccacaugaucgugagcagacaggagaagggcaagagccugcuguucaacaccggcgacggcgugcacaugugcacccugauggccaugcaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggaccuggagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcagcaucgugaccugcgccauguucaccugcaagaagaucaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaacgugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgccaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagaggagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacaccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacagaaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucagagccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuucgagcccgacguggaccugggcagcggcaccagaaacaucggcaucgagagcgagauccccaaccuggacaucaucggcaagagaaucgagaagaucaagcaggaguacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16934 - RNA, 9876 nt, Artificial Sequence
  derived and/or modified CDS sequence (opt4) from DENV-2__KF704355__SS-prME
accgccggcaugaucaucaugcugauccccaccgugauggccuuccaccugaccaccagaaacggcgagccccacaugaucgugagcagacaggagaagggcaagagccugcuguucaagaccggcgacggcgugaacaugugcacccugauggccauggaccugggcgagcugugcgaggacaccaucaccuacaagugccccuuccugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggaccuggagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcagcaucgugaccugcgccauguucaccugcaagaagaucaugaagggcaagguggugcagcccgagaaccuggaguacaccaucgugaucaccccccacagcggcgaggagcacgccgugggcaacgacaccggcaaguacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaacgugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucggcaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaccggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacagaaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucagagccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggaguacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16935 - RNA, 9876 nt, Artificial Sequence
  derived and/or modified CDS sequence (opt4) from DENV-2__KF704354__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugccccuuccugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaucaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaacgugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgccaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagaggagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacaccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggagacuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuggggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuucgagcccgacguggaccugggcagcggcaccagaaacaucggcaucgagagcgagauccccaaccuggacaucaucggcaagagaaucgagaagaucaagcaggaguacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16936 - RNA, 9876 nt, Artificial Sequence
  derived and/or modified CDS sequence (opt4) from DENV-2__KF704357__SS-prME
accgccggcaugaucaucaugcugauccccaccgugauggccuuccaccugaccaccagaaacggcgagccccacaugaucgugagcagacaggagaagggcaagagccugcuguucaagaccggcgacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggaccuggagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcagcaucgugaccugcgccauguucaccugcaagaagaucaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaacgugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgccaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagaggagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacaccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacagaaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucagagccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuucgagcccgacguggaccugggcagcggcaccagaaacaucggcaucgagagcgagauccccaaccuggacaucaucggcaagagaaucgagaagaucaagcaggaguacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16937 - RNA, 9876 nt, Artificial Sequence
  derived and/or modified CDS sequence (opt4) from DENV-2__KF704358__SS-prME
accgccggcaugaucaucaugcugauccccaccgugauggccuuccaccugaccaccagaaacggcgagccccacaugaucgugagcagacaggagaagggcaagagccugcuguucaacaccggcgacggcgugcacaugugcacccugauggccaugcaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggaccuggagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcagcaucgugaccugcgccauguucaccugcaagaagaucaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaacgugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgccaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaccggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacaccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucagagccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuucgagcccgacguggaccugggcagcggcaccagaaacaucggcaucgagagcgagauccccaaccuggacaucaucggcaagagaaucgagaagaucaagcaggaguacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16938 - RNA, 9876 nt, Artificial Sequence
  derived and/or modified CDS sequence (opt4) from DENV-2__KF041232__SS-prME
accgccggcgugaucaucaugcugauccccaccgccauggccuuccaccugaccaccagaaacggcgagccccacaugaucgugagcaagcaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacgccaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccacccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccaacgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccagaaacauccagaccgccaucaaccaggugagaagccugaucggcagcgaggaguacaccgacuacaugcccagcaugaagagauucagaagagaggaggaggaggccggcgugcugugguga

SEQ ID NO: 16939 - RNA, 9876 nt, Artificial Sequence
  derived and/or modified CDS sequence (opt4) from DENV-2__KF041233__SS-prME
accgccggcgugaucaucaugcugauccccaccgccauggccuuccaccugaccaccagaaacggcgagccccacaugaucgugagcaagcaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccgccgccauccagaaggcccacgaggagggcaucugcggcaucagaagcgugaccagacuggagaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugaucgccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccacccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccugguggagagcugggaggagauccccuaccugggcaagagagaggaccaguggugcggcagccugaucggccugaccagcagagccaccugggccagaaacauccagaccgccaucaaccaggugagaagccugaucggcagcgaggaguacaccgacuacaugcccagcaugaagagauucagaagagaggaggaggaggccggcgugcugugguga

SEQ ID NO: 16940 - RNA, 9876 nt, Artificial Sequence
  derived and/or modified CDS sequence (opt4) from DENV-2__KF041234__SS-prME
accgccggcgugaucaucaugcugauccccaccgccauggccuuccaccugaccaccagaaacggcgagccccacaugaucgugagcaagcaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacgccaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaaggugaucaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccacccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagagaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccaacgcccugaccgcccugaacgacaugggcaaggugagaaaggacauccagcagugggagcccagcagaggcuggagcgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccagaaacauccagaccgccaucaaccaggugagaagccugaucggcagcgaggaguacaccgacuacaugcccagcaugaagagauucagaagagaggaggaggaggccggcgugcugugguga

SEQ ID NO: 16941 - RNA, 9876 nt, Artificial Sequence
  derived and/or modified CDS sequence (opt4) from DENV-2__KF041235__SS-prME
accgccggcgugaucaucaugcugauccccaccgccauggccuuccaccugaccaccagaaacggcgagccccacaugaucgugagcaagcaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccacccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccagaaacauccagaccgccaucaaccaggugagaagccugaucggcagcgaggaguacaccgacuacaugcccagcaugaagagauucagaagagaggaggaggaggccggcgugcugugguga

SEQ ID NO: 16942 - RNA, 9876 nt, Artificial Sequence
  derived and/or modified CDS sequence (opt4) from DENV-2__KF041237__SS-prME
accgccggcgugaucaucaugcugauccccaccgccauggccuuccaccugaccaccagaaacggcgagccccacaugaucgugagcaagcaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccacccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccggccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccagaaacauccagaccgccaucaaccaggugagaagccugaucggcagcgaggaguacaccgacuacaugcccagcaugaagagauucagaagagaggaggaggaggccggcgugcugugguga

SEQ ID NO: 16943 - RNA, 9876 nt, Artificial Sequence
  derived and/or modified CDS sequence (opt4) from DENV-2__KM217156__SS-prME
accgccggcgugaucaucaugcugauccccaccgccauggccuuccaccugaccaccagaaacggcgagccccacaugaucgugagcaagcaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacgccaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaacccccuguucaccggccaccugaagugcagacugagaauggacaagcugcagcugaagggcaugagcuacagcaugugcaccggcaaguucaagguggugaaggagaucgccgagacccagcacggcaccaucguggugagaauccaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucuucaccgacaacgugcacaccuggaccgagcaguacaaguuccagcccgagagccccagcaagcuggccagcgccauccagaaggcccacgaggagggcaucugcggcaucagaagcaucaccagacuggacaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgcccagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccacccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccgccagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccagcagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagagugagccugcugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcugaccggcgccgacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgaccccgacguggaccugggcagcggcaccagaaacaucggcaucgagagcgagacccccaaccuggacaucaucggcaagagaaucgagaagaucaagcaggagcacgagaccagcagacacuacgaccaggaccaccccuacaagaccugggccuaccacggcagcuacgagaccaagcagaccggcagcgccagcagcaccgugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcgugcaggugggcaccuacggccugggcaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcuggugguggccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccggccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccagaaacauccagaccgccaucaaccaggugagaagccugaucggcagcgaggaguacaccgacuacaugcccagcaugaagagauucggcagagaggaggaggaggccggcgugcugugguga

SEQ ID NO: 16944 - RNA, 9876 nt, Artificial Sequence
  derived and/or modified CDS sequence (opt4) from DENV-2__KX380809__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgacagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16945 - RNA, 9876 nt, Artificial Sequence
  derived and/or modified CDS sequence (opt4) from DENV-2__KX380810__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgacagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccgccgccgacaucggcaccgugaucgaccuggaccccauccccuacgaccccaaguucgagaagcagcugggccaggugaugcugcuggugcugugcagcacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaucagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16946 - RNA, 9876 nt, Artificial Sequence
  derived and/or modified CDS sequence (opt4) from DENV-2__KX380811__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaaccugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16947 - RNA, 9876 nt, Artificial Sequence
  derived and/or modified CDS sequence (opt4) from DENV-2__KX380813__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagagcgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccagccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16948 - RNA, 9876 nt, Artificial Sequence
  derived and/or modified CDS sequence (opt4) from DENV-2__KX380814__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccagccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16949 - RNA, 9876 nt, Artificial Sequence
  derived and/or modified CDS sequence (opt4) from DENV-2__KX380807__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggccccccacgugggcaugggccuggagaccagaaccgagaccuggaugagcagcgagggcgccuggaagcacgcccagagaaucgagaucugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacaacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccguggacggcgaguacagacugagaggcgaggccagaaagaccuucguggaccugaugagaagaggcgaccugcccguguggcuggccuacaagguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagauccccgccgcccugaucgugaccgugaucgaccuggaccccauccccuacgaccccaaguucgagaagcagcugggccaggugaugcugcuggugcugugcagcacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugacccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16950 - RNA, 9876 nt, Artificial Sequence
  derived and/or modified CDS sequence (opt4) from DENV-2__KX380815__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacgugagcugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagcuuccugaagaacgacauccccaugaccggcccccugguggccggcggccugcugaccgugugcuacgugcugaccggcagaagcgccgaccuggagcuggagagagccgccgacaucagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagaacaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccgccgcccugaucaugaccgugaucgaccuggaccccauccccuacgaccccaaguucgagaagcagcugggccaggugaugcugcuggugcugugcagcacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaaccagcugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgccaccgaggagaucgccgugaagaacuggcuggugagagugggcagagagagacugagcagaauggccaucagcggcgacgacugcguggugaagccccuggacgacagauucgccaacgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16951 - RNA, 9876 nt, Artificial Sequence
  derived and/or modified CDS sequence (opt4) from DENV-2__KX380816__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccagccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16952 - RNA, 9876 nt, Artificial Sequence
  derived and/or modified CDS sequence (opt4) from DENV-2__KX380817__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16953 - RNA, 9876 nt, Artificial Sequence
  derived and/or modified CDS sequence (opt4) from DENV-2__KX380818__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacgugagcugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagcuuccugaagaacgacauccccaugaccggcccccugguggccggcggccugcugaccgugugcuacgugcugaccggcagaagcgccgaccuggagcuggagagagccgccgacaucagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagaacaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccgccgccgacaucggcagagugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaaccagcugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgccaccgaggagaucgccgugaagaacuggcuggugagagugggcagagagagacugagcagaauggccaucagcggcgacgacugcguggugaagccccuggacgacagauucgccaacgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16954 - RNA, 9876 nt, Artificial Sequence
  derived and/or modified CDS sequence (opt4) from DENV-2__KX380819__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcaucagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgacagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccgccgcccugaucggcagagugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaucagcagaaccaccuggagcauccacgccacccacgaguggaugaccaccgaggacaugcugaccgccuggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16955 - RNA, 9876 nt, Artificial Sequence
  derived and/or modified CDS sequence (opt4) from DENV-2__KX380821__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16956 - RNA, 9876 nt, Artificial Sequence
  derived and/or modified CDS sequence (opt4) from DENV-2__KX380822__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucaugaccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucaccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgacagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccgccgccgacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16957 - RNA, 9876 nt, Artificial Sequence
  derived and/or modified CDS sequence (opt4) from DENV-2__KX380828__SS-prME
accgccggcgugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagaugcuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacaagggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgcccccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggagcugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagaagaagaagcugaagcccagauggcuggacgccagaaucuacagcgacccccuggcccugaaggaguucaaggaguucgccgccggcagaaagagccugaccaugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucguggcccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcagagccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagagcauccagcaccugaccaccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcagcgaggaguacaccgacuacaugcccagcaugaagagauucagaagagaggaggaggaggccggcgugcugugguga

SEQ ID NO: 16958 - RNA, 9876 nt, Artificial Sequence
  derived and/or modified CDS sequence (opt4) from DENV-2__KX380829__SS-prME
accgccggcgugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagaugcuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacaagggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgcccccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggagcugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagaagaagaagcugaagcccagauggcuggacgccagaaucuacagcgacccccuggcccugaaggaguucaaggaguucgccgccggcagaaagagccugaccaugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucguggcccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcagagccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagagcauccagcaccugaccaccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcagcgaggaguacaccgacuacaugcccagcaugaagagauucagaagagaggaggaggaggccggcgugcugugguga

SEQ ID NO: 16959 - RNA, 9876 nt, Artificial Sequence
  derived and/or modified CDS sequence (opt4) from DENV-2__KX380830__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgacagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccgccgccgacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaucagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16960 - RNA, 9876 nt, Artificial Sequence
  derived and/or modified CDS sequence (opt4) from DENV-2__KX380831__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaaccugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaccaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16961 - RNA, 9876 nt, Artificial Sequence
  derived and/or modified CDS sequence (opt4) from DENV-2__KX380808__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugaagcagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgagaucaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacaccgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcuggugacccacuacgccaucaucggccccggccugcaggccaaggccaccagagaggcccagaagagagccgccgccggcaucaugaagauccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggccuguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16962 - RNA, 9876 nt, Artificial Sequence
  derived and/or modified CDS sequence (opt4) from DENV-2__KX380832__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucaugaccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucaccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgacagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccgccgccgacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16963 - RNA, 9876 nt, Artificial Sequence
  derived and/or modified CDS sequence (opt4) from DENV-2__KX380833__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgacagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccgccgccgacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaucagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16964 - RNA, 9876 nt, Artificial Sequence
  derived and/or modified CDS sequence (opt4) from DENV-2__KX380834__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaaccugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16965 - RNA, 9876 nt, Artificial Sequence
  derived and/or modified CDS sequence (opt4) from DENV-2__KX380835__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgacagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaucagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16966 - RNA, 9876 nt, Artificial Sequence
  derived and/or modified CDS sequence (opt4) from DENV-2__KX380836__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaucagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16967 - RNA, 9876 nt, Artificial Sequence
  derived and/or modified CDS sequence (opt4) from DENV-2__KX380838__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgccaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccacccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgacagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagauccccgccgccgacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaucagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16968 - RNA, 9876 nt, Artificial Sequence
  derived and/or modified CDS sequence (opt4) from DENV-2__KM279515__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgcccugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagaccugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16969 - RNA, 9876 nt, Artificial Sequence
  derived and/or modified CDS sequence (opt4) from DENV-2__KM279516__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaacauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16970 - RNA, 9876 nt, Artificial Sequence
  derived and/or modified CDS sequence (opt4) from DENV-2__KM279517__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagcccccccaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16971 - RNA, 9876 nt, Artificial Sequence
  derived and/or modified CDS sequence (opt4) from DENV-2__KM279518__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacagacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16972 - RNA, 9876 nt, Artificial Sequence
  derived and/or modified CDS sequence (opt4) from DENV-2__KM279519__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcuggccgugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16973 - RNA, 9876 nt, Artificial Sequence
  derived and/or modified CDS sequence (opt4) from DENV-2__KM279520__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccagaaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgcccugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagaccugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16974 - RNA, 9876 nt, Artificial Sequence
  derived and/or modified CDS sequence (opt4) from DENV-2__KM279521__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagcaccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16975 - RNA, 9876 nt, Artificial Sequence
  derived and/or modified CDS sequence (opt4) from DENV-2__KM279583__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggcccugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16976 - RNA, 9876 nt, Artificial Sequence
  derived and/or modified CDS sequence (opt4) from DENV-2__KM279585__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggacaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggaaccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16977 - RNA, 9876 nt, Artificial Sequence
  derived and/or modified CDS sequence (opt4) from DENV-2__KM279525__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugauccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaacauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16978 - RNA, 9876 nt, Artificial Sequence
  derived and/or modified CDS sequence (opt4) from DENV-2__KM279528__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccaagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16979 - RNA, 9876 nt, Artificial Sequence
  derived and/or modified CDS sequence (opt4) from DENV-2__KM279533__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgagaacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16980 - RNA, 9876 nt, Artificial Sequence
  derived and/or modified CDS sequence (opt4) from DENV-2__KM279535__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16981 - RNA, 9876 nt, Artificial Sequence
  derived and/or modified CDS sequence (opt4) from DENV-2__KM279539__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgaggagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16982 - RNA, 9876 nt, Artificial Sequence
  derived and/or modified CDS sequence (opt4) from DENV-2__KM279543__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcauguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16983 - RNA, 9876 nt, Artificial Sequence
  derived and/or modified CDS sequence (opt4) from DENV-2__KM279571__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16984 - RNA, 9876 nt, Artificial Sequence
  derived and/or modified CDS sequence (opt4) from DENV-2__KM279544__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaccagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcauguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccugguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16985 - RNA, 9876 nt, Artificial Sequence
  derived and/or modified CDS sequence (opt4) from DENV-2__KM279549__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacguggacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16986 - RNA, 9876 nt, Artificial Sequence
  derived and/or modified CDS sequence (opt4) from DENV-2__KM279552__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccacagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16987 - RNA, 9876 nt, Artificial Sequence
  derived and/or modified CDS sequence (opt4) from DENV-2__KM279557__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacagcaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16988 - RNA, 9876 nt, Artificial Sequence
  derived and/or modified CDS sequence (opt4) from DENV-2__KM279591__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacguggacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16989 - RNA, 9876 nt, Artificial Sequence
  derived and/or modified CDS sequence (opt4) from DENV-2__KM279558__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16990 - RNA, 9876 nt, Artificial Sequence
  derived and/or modified CDS sequence (opt4) from DENV-2__KM279564__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaucgaggaggaggaggccggcgugcugugguga

SEQ ID NO: 16991 - RNA, 9876 nt, Artificial Sequence
  derived and/or modified CDS sequence (opt4) from DENV-2__KM279595__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagaacaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaaggacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16992 - RNA, 9876 nt, Artificial Sequence
  derived and/or modified CDS sequence (opt4) from DENV-2__KM279566__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16993 - RNA, 9876 nt, Artificial Sequence
  derived and/or modified CDS sequence (opt4) from DENV-2__KM279574__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccagccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccuggagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16994 - RNA, 9876 nt, Artificial Sequence
  derived and/or modified CDS sequence (opt4) from DENV-2__KM279568__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacaucguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16995 - RNA, 9876 nt, Artificial Sequence
  derived and/or modified CDS sequence (opt4) from DENV-2__KM279569__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaaggacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16996 - RNA, 9876 nt, Artificial Sequence
  derived and/or modified CDS sequence (opt4) from DENV-2__KM279570__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccguggccgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16997 - RNA, 9876 nt, Artificial Sequence
  derived and/or modified CDS sequence (opt4) from DENV-2__KM279596__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccguggccgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16998 - RNA, 9876 nt, Artificial Sequence
  derived and/or modified CDS sequence (opt4) from DENV-2__FJ850072__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcgaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgcccugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcguggccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucaugaccaucagcugcgugcccaacgccaugauccugcugaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugagccugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccguguucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagaaugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 16999 - RNA, 9876 nt, Artificial Sequence
  derived and/or modified CDS sequence (opt4) from DENV-2__JN819419__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcguggaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcguggcccugcugagccagagcaccauccccgagaccauccuggagcugaccgacgcccuggcccugggcaugauggcccugaagaucgugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaacaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgccccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagauccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugaccagaauggccaucagcggcgacgacugcguggugaagcccaucgacgacagauucgccaacgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17000 - RNA, 9876 nt, Artificial Sequence
  derived and/or modified CDS sequence (opt4) from DENV-2__FJ850074__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcguggaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugcccaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcguggcccugcugagccagagcaccauccccgagaccauccuggagcugaccgacgcccuggcccugggcaugauggcccugaagaucgugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaagcaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugaccagaauggccaucagcggcgacgacugcguggugaagcccaucgacgacagauucgccaacgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17001 - RNA, 9876 nt, Artificial Sequence
  derived and/or modified CDS sequence (opt4) from DENV-2__FJ850076__SS-prME
accgccggcgccaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcguggaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugcccaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcguggcccugcugagccagagcaccauccccgagaccauccuggagcugaccgacgcccuggcccugggcaugauggcccugaagaucgugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacgugcccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaagcaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugaccagaauggccaucagcggcgacgacugcguggugaagcccaucgacgacagauucgccaacgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17002 - RNA, 9876 nt, Artificial Sequence
  derived and/or modified CDS sequence (opt4) from DENV-2__GQ868640__SS-prME
accgccggcgccaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcguggaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugcccaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaucaccgacgacaucggcaugggcgugaccuaccuggcccugcuggccgccuucaaggugagacccaccuucgccgccggccugcugcugagaaagcugaccagcaaggagcugaugauggccaccaucggcguggcccugcugagccagagcaccauccccgagaccauccuggagcugaccgacgcccuggcccugggcaugauggcccugaagaucgugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacgugcccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaagcaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugaccagaauggccaucagcggcgacgacugcguggugaagcccaucgacgacagauucgccaacgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17003 - RNA, 9876 nt, Artificial Sequence
  derived and/or modified CDS sequence (opt4) from DENV-2__FJ850078__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcguggaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucaacggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugcccaccgagagccacaaccagaccuuccugaucgacggccccgagaccgccgagugccccaacgccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcguggcccugcugagccagagcaccauccccgagaccauccuggagcugaccgacgcccuggcccugggcaugauggcccugaagaucgugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaagcaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccagaggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugaccagaauggccaucagcggcgacgacugcguggugaagcccaucgacgacagauucgccaacgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17004 - RNA, 9876 nt, Artificial Sequence
  derived and/or modified CDS sequence (opt4) from DENV-2__FJ850082__SS-prME
accgugggcgugaucgugaugcugauccccaccgccauggccuuccaccugaccaccagaaacggcgagccccacaugaucgugggcagacaggagaagggcaagagccugcuguucaagaccgagaacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcguggaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccgugaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcguggcccugcugagccagagcaccauccccgagaccauccuggagcugaccgacgcccuggcccugggcaugauggcccugaagaucgugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggagggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgacaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagauccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagaugaucaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugaccagaauggccaucagcggcgacgacugcguggugaagcccaucgacgacagauucgccaacgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17005 - RNA, 9876 nt, Artificial Sequence
  derived and/or modified CDS sequence (opt4) from DENV-2__FJ850085__SS-prME
accgugggcgugaucgugaugcugauccccaccgccauggccuuccaccugaccaccagaaacggcgagccccacaugaucgugggcagacaggagaagggcaagagccugcuguucaagaccgagaacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcguggaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccgugaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcguggcccugcugagccagagcaccauccccgagaccauccuggagcugaccgacgcccuggcccugggcaugauggcccugaagaucgugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggagggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgacaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagauccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagaugaucaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugaccagaauggccaucagcggcgacgacugcguggugaagcccaucgacgacagauucgccaacgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17006 - RNA, 9876 nt, Artificial Sequence
  derived and/or modified CDS sequence (opt4) from DENV-2__FJ850088__SS-prME
accgccggcgugaucgugaugcugauccccaccgugauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcguggaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucaacggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugcccaccgagagccacaaccagaccuuccugaucgacggccccgagaccgccgagugccccaacgccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagccuggugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcguggcccugcugagccagagcaccauccccgagaccauccuggagcugaccgacgcccuggcccugggcaugauggcccugaagguggugaagaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccuggugagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaagcaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcuggcccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcgugaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccagaggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaccuacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcagaaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugaccagaauggccaucagcggcgacgacugcguggugaagcccaucgacgacagauucgccaacgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17007 - RNA, 9876 nt, Artificial Sequence
  derived and/or modified CDS sequence (opt4) from DENV-2__FJ850091__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagagccgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgccaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17008 - RNA, 9876 nt, Artificial Sequence
  derived and/or modified CDS sequence (opt4) from DENV-2__GQ199890__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaucggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagagagccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccaccaucaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcaccaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaaaggaggaggaggaggccggcgugcugugguga

SEQ ID NO: 17009 - RNA, 9876 nt, Artificial Sequence
  derived and/or modified CDS sequence (opt4) from DENV-2__GQ868549__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaugggcaacgagggcuacaccgacuacaugcccagcaugaagagauucagaagagaggaggaggaggccggcgugcugugguga

SEQ ID NO: 17010 - RNA, 9876 nt, Artificial Sequence
  derived and/or modified CDS sequence (opt4) from DENV-2__GQ868551__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggugaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaugggcaacgagggcuacaccgacuacaugcccagcaugaagagauucagaagagaggaggaggaggccggcgugcugugguga

SEQ ID NO: 17011 - RNA, 9876 nt, Artificial Sequence
  derived and/or modified CDS sequence (opt4) from DENV-2__HM181971__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagaucgacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaugggcaacgagggcuacaccgacuacaugcccagcaugaagagauucagaagagaggaggaggaggccggcgugcugugguga

SEQ ID NO: 17012 - RNA, 9876 nt, Artificial Sequence
  derived and/or modified CDS sequence (opt4) from DENV-2__GU131881__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaagaacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17013 - RNA, 9876 nt, Artificial Sequence
  derived and/or modified CDS sequence (opt4) from DENV-2__FJ898461__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguuccagaccaccgugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcuggugguggugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagacugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17014 - RNA, 9876 nt, Artificial Sequence
  derived and/or modified CDS sequence (opt4) from DENV-2__FJ024473__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaccagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcgacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagauaccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagaccacccugaccauccugaucagaaccggccugcuggugaucagcggcguguuccccgugagcauccccaucaccgccgccgccugguaccugugggaggugaagaagcagagagccggcgugcugugggacgugcccagccccccccuggugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccguggacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgaggccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgcccagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17015 - RNA, 9876 nt, Artificial Sequence
  derived and/or modified CDS sequence (opt4) from DENV-2__FJ024474__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaucggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagauaccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgccagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagauccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugacccacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccguggacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgcccagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17016 - RNA, 9876 nt, Artificial Sequence
  derived and/or modified CDS sequence (opt4) from DENV-2__FJ024475__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcgacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagauaccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagaccacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccguggacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaugacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgcccagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17017 - RNA, 9867 nt, Artificial Sequence
  derived and/or modified CDS sequence (opt4) from DENV-2__FJ182012__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagauaccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagauccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugacccacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccguggacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugagccugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgcccagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17018 - RNA, 9876 nt, Artificial Sequence
  derived and/or modified CDS sequence (opt4) from DENV-2__EU854293__SS-prME
accgccggcaugaucaucaugcugauccccaccgugauggccuuccaccugaccaccagaaacggcgagccccacaugaucgugagcagacaggagaagggcaagagccugcuguucaagaccggcgacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagagcgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacgaggugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagauccugaccauccugaucagaaccggccugcuggugaucagcggccuguuccccgugagcaugcccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17019 - RNA, 9876 nt, Artificial Sequence
  derived and/or modified CDS sequence (opt4) from DENV-2__EU854294__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagauaccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccguggacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgcccagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17020 - RNA, 9876 nt, Artificial Sequence
  derived and/or modified CDS sequence (opt4) from DENV-2__FJ024477__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgccaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggccgccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17021 - RNA, 9876 nt, Artificial Sequence
  derived and/or modified CDS sequence (opt4) from DENV-2__GQ868552__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcaucgcccuguuccuggaggagaugcugagaaccagagugggcaccaagcacgccauccugcugguggccaucagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaagacugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccacgccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgagaacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccugagcgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17022 - RNA, 9876 nt, Artificial Sequence
  derived and/or modified CDS sequence (opt4) from DENV-2__GQ868553__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcaggugacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgugggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccaucuucgagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagauccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucagaaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgcccagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17023 - RNA, 9876 nt, Artificial Sequence
  derived and/or modified CDS sequence (opt4) from DENV-2__GQ868554__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccguggagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17024 - RNA, 9876 nt, Artificial Sequence
  derived and/or modified CDS sequence (opt4) from DENV-2__GQ868555__SS-prME
accgccggcgugaucgugaugcugauccccaccgccaucgccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgaggugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggagggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaucgaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17025 - RNA, 9876 nt, Artificial Sequence
  derived and/or modified CDS sequence (opt4) from DENV-2__GQ868556__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17026 - RNA, 9876 nt, Artificial Sequence
  derived and/or modified CDS sequence (opt4) from DENV-2__GQ868557__SS-prME
accgccggcgugaucgugaugcugauccccaccgccaucgccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgaggugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaacgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17027 - RNA, 9876 nt, Artificial Sequence
  derived and/or modified CDS sequence (opt4) from DENV-2__GU131947__SS-prME
accgccggcgugaucgugaugcugauccccaccgccaucgccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccaugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgaggugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcagagccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaucgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17028 - RNA, 9876 nt, Artificial Sequence
  derived and/or modified CDS sequence (opt4) from DENV-2__GQ868558__SS-prME
accgccggcgugaucgugaugcugauccccaccgccaucgccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcacagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggugcugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgaggugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacgccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaucgaggagaucgccgugcagaacuggcuggccaaggugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17029 - RNA, 9876 nt, Artificial Sequence
  derived and/or modified CDS sequence (opt4) from DENV-2__KJ189305__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgccagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacacccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17030 - RNA, 9876 nt, Artificial Sequence
  derived and/or modified CDS sequence (opt4) from DENV-2__FJ898451__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgugcugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17031 - RNA, 9876 nt, Artificial Sequence
  derived and/or modified CDS sequence (opt4) from DENV-2__HM488257__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgugaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuacgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccauggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagcacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaaagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgccaccgaggagaucgccgugaagaccuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17032 - RNA, 9876 nt, Artificial Sequence
  derived and/or modified CDS sequence (opt4) from DENV-2__HQ999999__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacauccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccaucaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagguggugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaccaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaagaccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuuccugacccccaugcugagacacagcaucgagaacagcagcgugaacgugagccugaccgccaucgccaaccaggccaccgugcugaugggccugggcaagggcuggccccugagcaagauggacaucggcgccccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17033 - RNA, 9876 nt, Artificial Sequence
  derived and/or modified CDS sequence (opt4) from DENV-2__FJ898449__SS-prME
accgccggcaugaucaucaugcugauccccaccgugauggccuuccaccugaccaccagaaacggcgagccccacaugaucgugagcagacaggagaagggcaagagccugcuguucaagaccaaggacggcaccaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcuggacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucaccagcgagcugaaccacauccugagcgagaacgaggugaagcugaccaucaugaccggcgacaucaagggcaucaugcaggugggcaagagaagccugagaccccagcccaccgagcugagauacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugagacugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacaacagacccggcuaccacacccagaccgccggccccuggcaccugggcaagcuggagauggacuucgacuucugcgagggcaccaccgugguggugaccgaggagugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggacgaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucagaaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagaaguaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccagaaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccagcgagggcaucaacuacgccgacagaagauggugcuucgacggcaccagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggccacaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucgugccccccgagagaugcgacacccugcugugcgacaucggcgagagcagccccaaccccaccguggaggccggcagaacccugagagugcugaaccugguggagaacuggcugaacaacaacacccaguucugcgugaaggugcugaaccccuacaugcccagcgugaucgagagaauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgaggccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccaagaaggugagaagcaacgccgcccugggcgccaucuucaccgacgagaacaaguggaagagcgccagagaggccguggaggacaacagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucaccaucgaggaccugaagaacgaggagaugaucaccaaccacauggccggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccagcgaggagaucgccgugcaggacuggcuggugagagugggcagagagagacugagcagaauggccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcugaccguguggaacagaguguggauccuggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17034 - RNA, 9876 nt, Artificial Sequence
  derived and/or modified CDS sequence (opt4) from DENV-2__FJ906966__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggccugaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagaugaucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaucaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugcagccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagacaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17035 - RNA, 9876 nt, Artificial Sequence
  derived and/or modified CDS sequence (opt4) from DENV-2__FJ906968__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagaugaucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaucaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugcagccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacgaggugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagauccugaccauccugaucagaaccggccugcuggugaucagcggccuguuccccgugagcauccccaucaccgccgccgccuggugccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17036 - RNA, 9876 nt, Artificial Sequence
  derived and/or modified CDS sequence (opt4) from DENV-2__FJ906969__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaucaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugcagccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagauccugaccauccugaucagaaccggccugcuggugaucagcggccuguuccccgugagcauccccaucaccgccgccgccuggugccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17037 - RNA, 9876 nt, Artificial Sequence
  derived and/or modified CDS sequence (opt4) from DENV-2__FJ898454__SS-prME
accgccggcgugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggccuacgaggagggcaucugcggcaucagaagcgugaccagacuggagaaccugauguggaagcagaucacccccgagcugaaccacauccugagcgagaacgaggccaagcugaccaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaagaacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaucaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccacccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagagagacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcagcgaggaguacaccgacuacaugcccagcaugaagagauucagaagagaggaggaggaggccggcgugcugugguga

SEQ ID NO: 17038 - RNA, 9876 nt, Artificial Sequence
  derived and/or modified CDS sequence (opt4) from DENV-2__JQ922551__SS-prME
accgugggcaugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugaagcagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccugcaagcacgcccagagaaucgagaccuggauccugagacaccccagcuucaccaucauggccgccauccuggccuacaccaucggcaccaccuacuuccagagagugguguuccugauggugcugaccgccguggcccugagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugagaaagcacagcaugguggacagaggcuggggcaacggcugcggccuguucggcaagggcggcaucgugaccugcgccauguucaccugcaagaagaacauggagggcaagaucgugcagcccgagaaccuggaguacacccuggugaucaccccccacagcggcgaggagaacgccgugggcaacgacaccggcaaccacggcaaggagaucaaggugaccccccagagcagcaucaccgaggccgcccugaccggcuacggcaccgugaccauggagugcagccccagaaccggccugaacuuccacgagauggugagccugcccauggagaacaaggccuggauggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaaggugguguggggcaucgccagaacccagcacggcaccaucgugcacagagugcaguacgagggcgacggcagccccugcaagaucccccugaacaucaugggccuggagaagagacacgugcugggcagacccaucaccgugaaccccaucgugaccggcaaggacagccccgugaacaucgaggccgagcccccccugggcgacagcuacaucaucaucggcguggagcccggccaggugaagcugaccugcagccagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccagcaccaacagagccuggaacagccugaagggcggcgacuacggcuucggcguguucaccaccaacaucuggcugaagcugaaggagagacaggacgugagcugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccgagcacgagcagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgugcccaacgccaugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuaccugcugcccggcagaagcgccgaccuggagcuggagagagccgccgaccugagaugggaggaccaggccgagaucagcggcagcagccccauccugagcaucaccaucagcgaggacggcagcaugagcaucaagaaccaggaggagaagcagacccugaccauccugaucaagaccggccugcuggugaucagcgagcuguuccccgugcagauccccaucaccgccgccgccugguaccugugggaggugaagaagcagagagccggcgugcugugggacgugcccagccccccccccgugggcaaggccgagcuggaggacggcgccuacggcaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccagacccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagaagaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgccguggccgccaccauggccaacgagaugggcuuccuggagaagaccaagaaggacuucggccugggcagcaucgccacccagccccccgagagcaacauccuggacaucgaccugagacccgccagcgccuggacccuguacgccguggccaccaccuucaucaccagcaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcgugaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagagcgacaccagaacccaggagcccaaggagggcaccaagaagcugaugaagaucacccccaaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagaugggcgccaaccaccuggagggcgagcccaagaagcuguacgaggccaucuucaagcugaccuaccagaacaagggcgugagagugcagagacccacccccagaggcccccugauggacaucauccugagaagagaccagggcggcagcggccaggugggcaccuacggccugaacaccuucaccaacaugggcgcccagcugaucagacagauggagggcgagggcguguucaagggcauccagcaccugaucgccaccgaggagaucgccgugcaggacuggcuggccagagugggcagagagagauucagcagaauggccaucagcggcgacgacugcguggugaagccccuggacgacagauucgccagcgcccugaccgcccugaacgacaugggcaaggagagaaaggugcugcagcagugggagcccagcagagaguggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccagauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17039 - RNA, 9876 nt, Artificial Sequence
  derived and/or modified CDS sequence (opt4) from DENV-2__JQ922550__SS-prME
accgugggcaugaucaucaugcugauccccaccgugauggccagccaccugaccaccagaaacggcggcccccacaugaucgugaucggccagcagaagagaaagaccagcuucuucaagaccaagaagggccacgacaugugcacccugauggccauggccuucggcgaguucugcgagaacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaacaugaagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucaaggaccuggagaagagacacgugcugggcagacugaucaccgugaaccccaucgugaccgagaaggacagccccgugaacaucgaggccgagcccccccugggcgacagcuacaucaucaucggcguggagcccggccagcugaagcuggacugguucaagaagggcagcagcaucggccagauguucgagaacaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcggcggcugcgagagaaagaccaagaccaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugagauacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugagacugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggggcaacggcgugcuggagagcgagauggugauccccaagaacuucgccggccccgugagccagcacaacaacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccccaaguacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugagcagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcggcaccagcaagagaagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggacgaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccuggugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucagaaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagacccugcuggagcugaucagaggcggccccauccccguguaccugggcuacaaguggcccggcgagggcaucaacuacgccgacagcagacugugcgugggcagaacccagaacaaccagauccuggaggagaacguggagguggagaucuggaccaaggagggcaagggcaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggcaacaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccauccugauccagauggccaacauccugagaggcagcuaccuggccggcgccggcccccuguucagcaucauggagaacaccaccggccccagaagaagaaccggccagcugggcagagagcugcugagaagauggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagagaugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaauccaggagcccaaggagggcaccaagaagcugaugaagaucauggccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccugggcgcccugaagaacgagagaaagugcaccgagcacauggagggcgagcccagaaagcccggcagaggccacuucaaguggagaaaccagaacagaguggugggcgugcagggccccacccccggcggcaccgugauggacaucaucagcagaaagaaccagagaggcagcggccaggugggcaccuacggccugaacaccuucaccaacauggaggcccagcugaucagacagauggagggcgagggcuucuucaucgagcaccagcaccugaccgccagcgaggagaacgccgugcaggacuggcuggccagagugggcagagagaaggugagcagaaugcccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagcuucggcgagaccgccugccugggcaagagcuacgcccagauguggagccugaucaacuucagaauccccgaccugagacuggccgccaacgugaucugcagcguggugcccagccacugggugcccaccagcagaaccaccuggagcauccacgccaaccacgaguggaugaccaccgaggacaugcugaccguguggaacagaguguggauccuggagaaccccuggauggaggacaagacccccguggagagcugggaggagauccccuaccuggagaagagagaggaccaguggugcggcagccugaucggccugaccccccagccccccugggccaagaacaucgagaccgccaucaaccaggugagaagccugaucggcaacgaggaguacaucgacuaccugcccagcaugaagagauucagaaucgaggaggaggagagcggcuuccugugguga

SEQ ID NO: 17040 - RNA, 9876 nt, Artificial Sequence
  derived and/or modified CDS sequence (opt4) from DENV-2__JQ922553__SS-prME
accgccggcaugaucaucaugcugauccccaccgugauggccuuccaccugaccaccagaaacguggagccccccaugaucuucagcagacaggagaagggcaagagcuuccuguucaagaccaaggacggccacgacaugugcaccuucauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagugcugaucuucauccugcugaccggcguggcccccagcaugagaaugagaugcaucggcaucagcaacagagacuucguggagggcgugagcggcggcagcuggguggacaucgugcuggagcacggcagcugcgugaccaccauggccaagaacaagcccacccuggaccuggagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcgccaucgugaccugcgccauguucaccugcaagaagagcaugaagggcaagaucgugcagcccgagaaccuggaguacaccguggugaucaccccccacagcggcgaggaguacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcuggacugguucaagaagggcagcagcaucggccagaugcuggagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccuggagcugaaccacauccugagcgagaacgaggugaagcugaccaucaugaccggcgacaucaagggcaucaugcaggugggcaagagaagccugagaccccagcccaccgagcugagauacagcuggaagaccuggggcaaggccaagaugcugagcaccgagcugcacaaccagaccuuccugaucgacggccccgagaccgccgagugccccaacgccaacagagccuggaacagccuggagguggaggacuacggcuucagaaaguacaagaccaagaucuggcccacccugaaggaguggagaaagguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggggcaacggcgugcaggagagcgagauggugauccccaagaacuucgccggccccgugagccagcacaacaacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggccggcugcugguacuggauggacaucagaccccugaaggagaaggagaagaaccuggugagcagccuggugaccgccggccacggccagaucgacaacuucagccugagaauccugggcauggcccuguuccuggagaagaugcugaugaccagacugggcaccaagcacgccauccugcugguggccgugagcuucgugacccugaucaccagaaacaugagcuucaaggaccugggcagagugauggugauggugggcgccaccaugaccgacgacaugagaaugggcgugaccuaccuggcccugcugcccgccuucaaggugagacccaccuucgccaccggccugcugcugagaaagcugaccagcaaggagcugaugaugaccaccaucggcaucgugcuguucagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggagagugagcugcaccauccuggccguggugagcgugagcccccuguuccugaccagcagcagacagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggacgaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaauccagcagaagggcaucuucggcuacagccagaucggcgccggcguguacaaggagggcaccuuccccaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacuaccccgagguggagauggacaucuucagaaagaagagacugaccaucauggacuuccaccccggcgccggcagacagaagagauacuuccccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaucgugugguucgugcccagccugaagaccggcaaguacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagacccugcuggagcugaucagaggcggccccauccccguguaccugggcuacaaguggcccggcgagggcaucaacuacgccgacagcagacugugcuucgacggcaucaagaacaaccagauccuggaggagaacguggagguggagaucuggaccaaggagggcgagagaaaggagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaggcgcccuggccagccugauggugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaccgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggcaacaucgccacccagcagagcugcaagaagauccuggacaucuaccugggccccgcccugcccuggaagcuguacgccggcggcaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaagcccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucgacgagagaaaccuggugacccccgagggcaaggugguggaccugggcugcggcagaggcggcuggagcuucuucugcggcggccugaagaacgugagagaggugaaggcccugaccaucggcggccccggccacgaggagcccauccugaugagcaccuacggcagaaaccuggugagaagccagagcggcguggugguguuccacaccccccccgagaagugcgacaccagccugagagacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccuggggcagccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaucaagaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagagaaagaccaaccacaugggcggcgagcacagaaagcuggccagaggcaucuucaagaugaaccugaccaacaagguggugagagugcagagacccacccccggcggcacccugauggacaucaucagcagaaagacccagagaggcagcgagcaggugggcaccuacggccugaccacccugaccaaccuggaggccccccccaucagacagauggagggcaagggcguguucaagggccaccagcacagaaccgccagcgaggagaacgccgugcaggacuggcuggccagagugggcggcgagagacugagcagacuggccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagccugagagagaccgccugccugggcaaguucuacgcccagagauggagccugauguacuuccacagaagagaccugagacuggcccccaacgccaucugcagcgccgugagaacccacugggugcccaccagcagaaagaccuggcccauccacgccagccacgacuggaugaccaccgaggugaugcugaccguguggaacaagcugugguuccaggagaaccccuggauggaggacaagacccccgugggcuucugggaggagauccccuuccuggagaagggcaaggaccaguggggcggcagccugaucggccugaccagcagaccccccugggccaagaacuuccagcccgccaucaaccaggugagaagccugcugugcaacgaggagagcgccgacuucaugcccagcaugaagagauucagaagagaggaggaggaggccggcgugcugugguga

SEQ ID NO: 17041 - RNA, 9876 nt, Artificial Sequence
  derived and/or modified CDS sequence (opt4) from DENV-2__JQ922549__SS-prME
accgccggcgugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgcccccggcgaccacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugauccugauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugaccaaguacugcaucgaggccaagcugaccaacaccaccaccgccagcagaugccccacccagggcgagcccagccugaacgaggagcagcacaagagauucgugugcaagcacagcaugguggacagaggcuggggcaacggcugcggccuguucggcaagggcggcaucgugaccugcgccauguucaccugcaagaagaacaugaagggcaagaucgugcagcccgagaaccuggaguacaccaucguggugaccccccacagcggcgaggagaacgccgugggcaacgacaccggcaagcacggcaaggagaucaaggugagaccccagagcagcaucaccgaggccgagcugaccggcuacggcaccgugaccauggagugcagccccagaaccggcuucgccuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacuggugcugggcagacugaucaccgugaaccccaucgugaccgagaaggacagccccgugaacaucgaggccgagccccccuucggcgacagcuacaucaucaucggcguggagcccggccagcugaagcccagcugguucaagaagggcagcagcaucagacagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaccaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucggcggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuuccacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccuggagggcgaggagggcgaccuggugcacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcagaaugauccugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcuggagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaaguacgaggaggaggagcccacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcagcagccagaucggcgccagaguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcaccgugagccuggacuucagccccggcaccagcgagagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagccccgugaacgugagccugaccgccaucgccaaccaggccaccgugcugaugggccugggcaagggcuggccccugagcaagauggacaucggcgugcccccccuggccaucggcugcuacagccaggugaaccccaucacccugaccgccgcccugcugcugcugguggcccacuacgccaucaucggccccggccugcaggugaaggccaccagagaggcccagaagagagccgccgccggcaucaugaagaaccccaccguggacggcaucaccgugaucgaccuggaccccauccccuacgaccccaaguucgagaagcagcugggccagaucaugcugagagugcugugcgugacccaggugcugaugaugagaaccaccugggcccugugcgaggcccugacccuggccaccggccccaucagcacccugugggagggcaaccccggcagacugggcaacaccaccaucgccgugagcauggccaacaucuucagaggcagcuaccuggccggcgccggccugcuguucagcaucaugaagaacaccaccaacaccagaagaggcaccagcaaccugggcgagacccugggcgagaaguggaagaacagacugaacagccugggcaagagcgaguuccagaucuacaagaagagcggcauccaggagguggacagaacccuggccaaggagggcaucaagaagggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcgaggacguguucuucaccccccccgagaagugcgacacccugcugugcgacaucggcgagagcagccccaaccccaccguggaggccggcagaacccugagagugcugaacaugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagccuggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucagcagaaaggugagaagcaacgccgcccugggcgccaucuucaccgacgagaacaaguggaagagcgccagagaggccguggaggacggcagauucugggagcugguggacaaggagagaauccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagaucgccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccagaagcauccacgccagacaggaguggaugaccaccgaggugaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcagcgaggaguacaccgacuacaugcccagcaugaagagauucagaagagaggaggaggaggccggcgugcugugguga

SEQ ID NO: 17042 - RNA, 9876 nt, Artificial Sequence
  derived and/or modified CDS sequence (opt4) from DENV-2__JQ922552__SS-prME
accgccggcaugaucaucaugcugauccccaccgugauggccuuccaccugaccaccagaaacggcgagccccccaugaucgugagcagacaggagaagggcaagagccugcuguucaagaccgaggacggcgugaacaugugcgcccugauggccauggaccugggcgagagaugcgaggacaccaucaccuacaacugcccccugcugaaccagaacgagcccgaggacaucgacugcuggugcaacagcaccagcaccugggugaccuacggcaccugcaccaccaccggcgagcugagaagagagaagaucagcguggcccuggugccccacgugggcaugggccuggagaccagaaccgagaccuggaugagcagcgagggcgccuggaagcacgcccagagaaucgagaucuggauccugagacaccccggcuucaccaucauggccgccauccuggccuacaccaucggcaccagccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaucaugaagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagaugcuggagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaccggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacauguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggugggcaagagaagccugagaccccagcccaccgagcugagauacagcuggaagaccuggggccagcccaagaugcugagccccgagcugcaccaccagaccuuccugaucgacggccccgagaccgccgagugccccaacaccaacagaaccugggacagccuggagguggaggacuacggcuucggcguguucaccaccaagaucuggcugagacugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaugggcgugcuggagagcgagauggugauccccaagaacuucgccggccccgugagccagcacaaccacagacccggcauccccacccagaccgccggccccuggcaccugggcaagcuggagauggacuucgacuucugcgagggcaccaccgugguggugaccgaggacugcggcaacagaggccccagccugagaaccagcaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcggcagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggcccuggugagcgugagcccccuguuccugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggacgaccaggccgagaucagcggcagcagccccauccugagcaucaccaucagcgaggacggcagcaugagcaucaagaacgaggaggaggagcagacccugaccauccugaucagaaccgagcugcuggugaucagcggccuguuccccaucagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaagaaagaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaggccccgccgagggcaucaacuacgccgacagaagauggugcuucgacggcaucaagaacagccaguuccuggaggagaacguggagguggagaucuggcccagcggcggcgagagaaaggagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggcaacaucgugacccagcagcccgagagcaacauccuggacaucgaccugagacccgccagcgccuggacccuguacgccgccgccaccaccuucaucacccccaugcugagacacagcaucgagaacagcagcgugaacaugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaagggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcagcagccagguguggcccagcaucaacaaccugaagggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugccccagagaggaguucaccaagaaggugagaagcaacgccgcccugggcgccaucuucaccgacgccaccaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagaaagaaggagggcggcgccauguacgccgacgacagcgccggcugggacaccagaaucacccuggaggaccugaagaacgaggagagaaucaccaaccacauggagguggagcacaagaagcuggccgugggccacuucauccugaccuaccccaacaagguggugagagugcagagacccacccccgugggcaccgugauggacaucaucagcagaaagagccagagaggcagcggccaggugggcaccuacggccugaacaccuucaccaaccuggagggccccagaaucagacagauggagggcgaggagagcuucaagagccaccagcugcagaccgccaccgagagaaacgccgugcaggacuggcuggccagagugggcagagagagacugagcagaauggccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggguggccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17043 - RNA, 9876 nt, Artificial Sequence
  derived and/or modified CDS sequence (opt4) from DENV-2__GU131896__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagacugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcgugggcaaggcccugcaccagaucuucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgacagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17044 - RNA, 9876 nt, Artificial Sequence
  derived and/or modified CDS sequence (opt4) from DENV-2__GU131897__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccugaucaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugauggacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17045 - RNA, 9876 nt, Artificial Sequence
  derived and/or modified CDS sequence (opt4) from DENV-2__GQ868631__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaagggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcguggccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugauggccaccaucggcaucgugcugcugagccagagcaccauccccgagaccgugcuggagcugaccgacgcccuggcccugggcaugauggcccugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggccaugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17046 - RNA, 9876 nt, Artificial Sequence
  derived and/or modified CDS sequence (opt4) from DENV-2__GU131899__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccgugaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17047 - RNA, 9876 nt, Artificial Sequence
  derived and/or modified CDS sequence (opt4) from DENV-2__GU131900__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaaggacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17048 - RNA, 9876 nt, Artificial Sequence
  derived and/or modified CDS sequence (opt4) from DENV-2__GU131901__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17049 - RNA, 9876 nt, Artificial Sequence
  derived and/or modified CDS sequence (opt4) from DENV-2__GU131902__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucgccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17050 - RNA, 9876 nt, Artificial Sequence
  derived and/or modified CDS sequence (opt4) from DENV-2__GU131924__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaagaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagaucgugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17051 - RNA, 9876 nt, Artificial Sequence
  derived and/or modified CDS sequence (opt4) from DENV-2__GQ868638__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagacugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcgugggcaaggcccugcaccagaucuucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgacagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagagcccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucagaaacauccagcaccugaccgccaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17052 - RNA, 9876 nt, Artificial Sequence
  derived and/or modified CDS sequence (opt4) from DENV-2__GU131927__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccagaaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcgugggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcagaagaagccugagaccccagcccaccgagcugaaguacagcuggaagaccuggggcaaggccaagaugcugagcaccgagagcuacaaccagaccuuccugaucgacggccccgagaccaccgagugccccaacgccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagagccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaccgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacaccagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccacccagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17053 - RNA, 9876 nt, Artificial Sequence
  derived and/or modified CDS sequence (opt4) from DENV-2__GU131928__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcguggccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17054 - RNA, 9876 nt, Artificial Sequence
  derived and/or modified CDS sequence (opt4) from DENV-2__GU131929__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaucagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcguggccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcuguucaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17055 - RNA, 9876 nt, Artificial Sequence
  derived and/or modified CDS sequence (opt4) from DENV-2__GU131930__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagagcaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcaccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacaccggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17056 - RNA, 9876 nt, Artificial Sequence
  derived and/or modified CDS sequence (opt4) from DENV-2__GU131931__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggcccacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagaucuucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17057 - RNA, 9876 nt, Artificial Sequence
  derived and/or modified CDS sequence (opt4) from DENV-2__GU131932__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17058 - RNA, 9876 nt, Artificial Sequence
  derived and/or modified CDS sequence (opt4) from DENV-2__GQ199892__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcgcccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcauccugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcagagccuacacccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17059 - RNA, 9876 nt, Artificial Sequence
  derived and/or modified CDS sequence (opt4) from DENV-2__JF730044__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaaggagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcagcaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaugggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccgugacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugggcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17060 - RNA, 9876 nt, Artificial Sequence
  derived and/or modified CDS sequence (opt4) from DENV-2__FJ639697__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaaggagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcagcaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaugggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccgugacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcuggacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugggcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagaaccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17061 - RNA, 9876 nt, Artificial Sequence
  derived and/or modified CDS sequence (opt4) from DENV-2__FJ639698__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaaggagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagcugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucaucaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgaccccaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagggcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucagcgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagaacgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccaaguggcuguggaaggagcugggcaagaagaagacccccagaaucugcaccagagaggaguucaccaagaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagguggccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17062 - RNA, 9876 nt, Artificial Sequence
  derived and/or modified CDS sequence (opt4) from DENV-2__FJ639699__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaaggagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagcugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucaucaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagggcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugaugauccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagaacgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccaaguggcuguggaaggagcugggcaagaagaagacccccagaaucugcaccagagaggaguucaccaagaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccaguaccugaccgugaccgaggagguggccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17063 - RNA, 9876 nt, Artificial Sequence
  derived and/or modified CDS sequence (opt4) from DENV-2__FJ639700__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaaggagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagcugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucaucaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggccaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagggcuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugaugauccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagaacgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccaaguggcuguggaaggagcugggcaagaagaagacccccagaaucugcaccagagaggaguucaccaagaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccaguaccugaccgugaccgaggagguggccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17064 - RNA, 9876 nt, Artificial Sequence
  derived and/or modified CDS sequence (opt4) from DENV-2__GQ868620__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagaguggugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacgccaacaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacgacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcugguacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaucagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucgagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17065 - RNA, 9876 nt, Artificial Sequence
  derived and/or modified CDS sequence (opt4) from DENV-2__FJ639702__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaaggagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcagcaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaugggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagccuggugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcaaggaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcguguuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccgugacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugggcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17066 - RNA, 9876 nt, Artificial Sequence
  derived and/or modified CDS sequence (opt4) from DENV-2__GQ868621__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacauccugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucaugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcacacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga
